(12) United States Patent
Han

(10) Patent No.: US 11,047,011 B2
(45) Date of Patent: Jun. 29, 2021

(54) IMMUNOREPERTOIRE NORMALITY ASSESSMENT METHOD AND ITS USE

(71) Applicant: iRepertoire, Inc., Huntsville, AL (US)

(72) Inventor: Jian Han, Huntsville, AL (US)

(73) Assignee: iRepertoire, Inc., Huntsville, AL (US)

( * ) Notice: Subject to any disclaimer, the term of this patent is extended or adjusted under 35 U.S.C. 154(b) by 542 days.

(21) Appl. No.: 15/278,998

(22) Filed: Sep. 28, 2016

(65) Prior Publication Data

US 2017/0088895 A1   Mar. 30, 2017

Related U.S. Application Data

(60) Provisional application No. 62/234,424, filed on Sep. 29, 2015.

(51) Int. Cl.
  *C12Q 1/68*     (2018.01)
  *C12Q 1/6883*   (2018.01)

(52) U.S. Cl.
  CPC ..... *C12Q 1/6883* (2013.01); *C12Q 2600/158* (2013.01); *C12Q 2600/16* (2013.01)

(58) Field of Classification Search
  None
  See application file for complete search history.

(56) References Cited

U.S. PATENT DOCUMENTS

| | | | | |
|---|---|---|---|---|
| 9,234,240 B2 * | 1/2016 | Quake | ................ | G16B 30/00 |
| 2010/0021896 A1 * | 1/2010 | Han | ................ | C12Q 1/686 |
| | | | | 435/6.16 |
| 2012/0171725 A1 * | 7/2012 | Han | ................ | C12P 19/34 |
| | | | | 435/91.2 |
| 2014/0127699 A1 * | 5/2014 | Han | ................ | C12Q 1/686 |
| | | | | 435/6.12 |

FOREIGN PATENT DOCUMENTS

| WO | WO-2009137255 A2 * | 11/2009 | .......... C12Q 1/6881 |
|---|---|---|---|
| WO | 2012097374 A1 | 7/2012 | |
| WO | 2014124451 A1 | 8/2014 | |
| WO | 2014179202 A1 | 11/2014 | |

OTHER PUBLICATIONS

Han Y, Li H, Guan Y, Huang J. Immune repertoire: A potential biomarker and therapeutic for hepatocellular carcinoma. Cancer Lett. Sep. 1, 2016; 379(2):206-12. Epub Jul. 15, 2015. (Year: 2015).*
Wang et al. High throughput sequencing reveals a complex pattern of dynamic interrelationships among human T cell subsets. Proceedings of the National Academy of Sciences. Jan. 26, 2010; 107(4):1518-23. (Year: 2010).*
Madi, et al., "T-Cell receptor repertoires share a restricted set of public and abundant CDR3 sequences that are associated with self-related immunity," Genome Res., Jul. 14, 2014.
Mamedov, et al., "Preparing unbiased T-cell receptor and antibody cDNA libraries for the deep next generation sequencing profiling," Front Immunol., Dec. 23, 2013.

* cited by examiner

*Primary Examiner* — Teresa E Strzelecka
*Assistant Examiner* — Olayinka A Oyeyemi
(74) *Attorney, Agent, or Firm* — Maynard Cooper & Gale, P. C.; Matthew J. Parker

(57) ABSTRACT

The present disclosure generally pertains to a method for comparing the immunorepertoire diversity of a patient to the shared immunorepertoire of a group of individuals to identify whether the immunorepertoire diversity of the patient is normal or abnormal relative to the shared immunorepertoire of the group of individuals.

15 Claims, 1 Drawing Sheet
Specification includes a Sequence Listing.

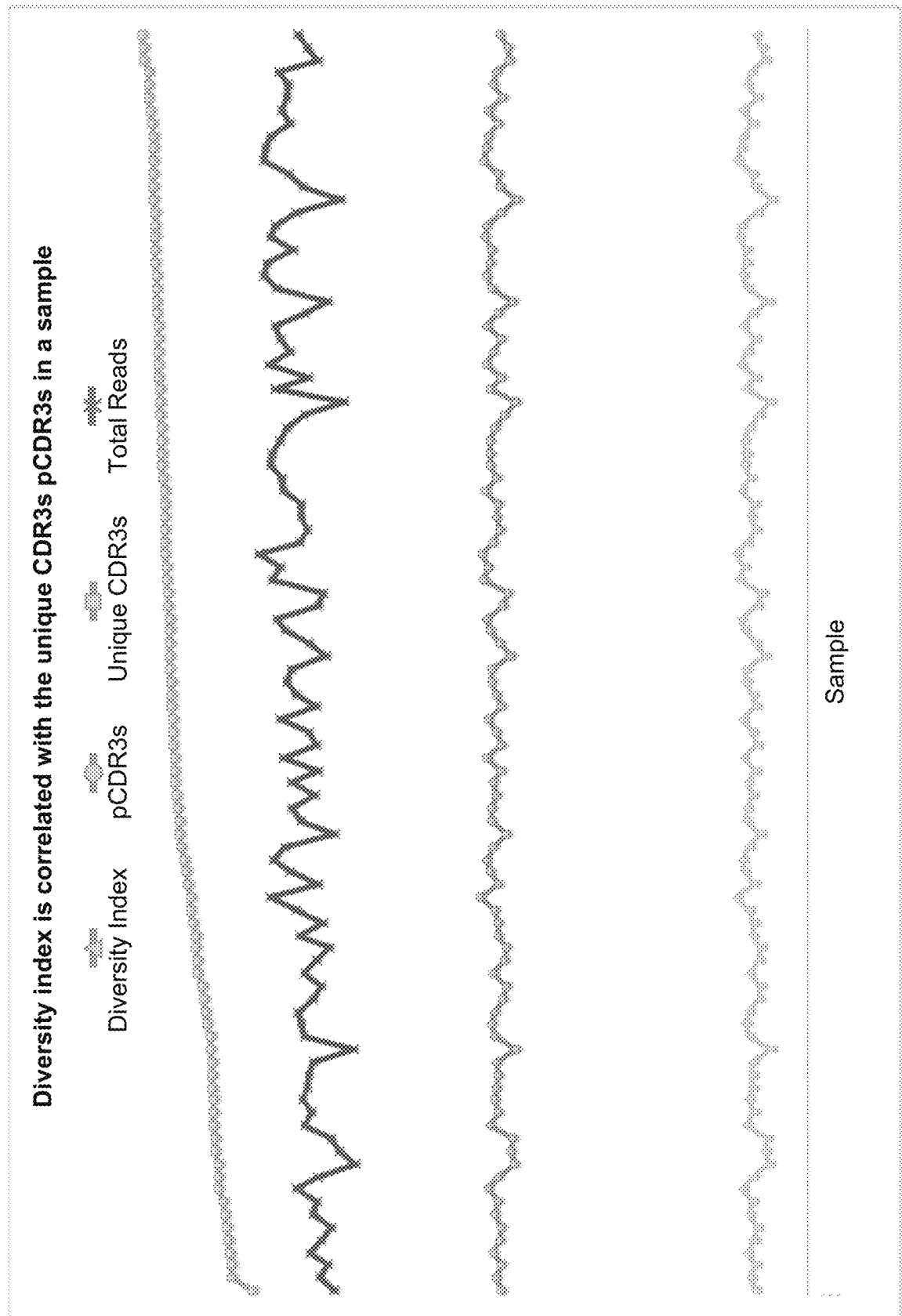

US 11,047,011 B2

IMMUNOREPERTOIRE NORMALITY ASSESSMENT METHOD AND ITS USE

CROSS REFERENCE TO RELATED APPLICATION

This application claims priority to U.S. Provisional Patent Application No. 62/234,424, entitled "Immunorepertoire Normality Assessment Method and Its Use" and filed on Sep. 29, 2015, which is incorporated herein by reference.

FIELD OF INVENTION

The present disclosure relates to methods for performing diagnostic tests. More specifically, the present disclosure relates to diagnostic tests for the assessment of immunorepertoire diversity relative to a standard index.

BACKGROUND OF INVENTION

Diagnostic tests may be used to detect the presence or absence of the normal state in a patient, and the results of these tests may be used to screen patients and collectively aid in diagnosis. For example, a normal white blood cell count is between 4,500 and 10,000 cells per microliter. An elevated white blood cell count is not determinative for a specific disease, but it may indicate an underlying problem that requires medical evaluation. Normal ranges of red blood cell counts for women and men are generally different, with a count of 5 to 6 million per microliter being normal for males and 3.6 to 5.6 million being normal for females. Platelet counts are normal if they are within the range of 150,000 to 400,000. In the presence of inflammation, for example, red cell count may go down, white cell count may go up, and platelet count may also be elevated.

Similarly, heart disease, the tendency to have heart disease, signs of certain cancers, and a variety of genetic diseases may have as their early signs one or more abnormal results for a variety of diagnostic tests. Such diagnostic tests include, for example, measures of albumin, alkaline phosphatase, alanine transaminase (ALT), aspartate aminotransferase (AST), blood urea nitrogen (BUN), serum calcium, serum chloride, carbon dioxide, creatinine, direct bilirubin, gamma-glutamyl-transpeptidase (gamma-GT), glucose, lactate dehydrogenase (LDH), serum phosphorus, potassium, serum sodium, total bilirubin, total cholesterol, total protein, and uric acid.

In addition, blood glucose levels may also be used as early indicators associated with diseases as varied as Cushing syndrome, hyperthyroidism, pancreatic cancer, pancreatitis, pre-diabetes, and diabetes.

As described above, diagnostic tests are currently available and performed on a regular basis to detect the presence or absence of a normal state in an individual. These tests, however, do not address the diversity of the immunorepertoire in a patient. The ability to detect the presence or absence of a diverse immunorepertoire, relative to a standard, in an individual may assist with an assessment of the health of such individual.

SUMMARY OF INVENTION

The present disclosure relates to a method for A method for determining the immunorepertoire diversity in a patient. The method comprises: quantifying the expression of third complementarity-determining region ("CDR3") in a population or sub-population of immune system cells in a patient sample; and identifying the percentage of pCDR3 represented by such CDR3s within that population or sub-population, wherein normal immunorepertoire diversity is characterized by the presence of a minimum percentage of pCDR3 and an abnormal immunorepertoire diversity status is characterized by the absence of a minimum percentage of pCDR3.

In certain embodiments, the minimum percentage of pCDR3 in such method is a percentage number selected from about 25 percent to about 75 percent. In other embodiments, the minimum percentage of pCDR3 is about 25 percent. In other embodiments, the pCDR3 is composed of about the 1000 most-frequently-shared CDR3. In other embodiments, the pCDR3 is composed of more than 1000 of the most-frequently-shared CDR3. In yet other embodiments, the pCDR3 is composed of fewer than 1000 of the most-frequently-shared CDR3. In other embodiments, the pCDR3 is composed of CDR3 shared by at least 25 percent of a pool of individuals.

In certain embodiments, the pCDR3 is composed of CDR3 shared by at least 50 percent of a pool of individuals. In certain embodiments, such pool contains at least 100 individuals. In other embodiments, such pool contains about 1000 individuals.

The present disclosure also relates to a method for determining the immunorepertoire diversity in a patient. The method comprises: amplifying polynucleotides from a population of white blood cells from a human or animal subject in a reaction mix comprising target-specific nested primers to produce a set of first amplicons, at least a portion of the target-specific nested primers comprising additional nucleotides which, during amplification, serve as a template for incorporating into the first amplicons a binding site for at least one common primer; transferring a portion of the first reaction mix containing the first amplicons to a second reaction mix comprising at least one common primer; amplifying, using the at least one common primer, the first amplicons to produce a set of second amplicons; sequencing the second amplicons to identify CDR3 sequences in the subpopulation of white blood cells; using the identified CDR3 sequences to quantify the percentage of pCDR3 represented by the sample to provide a normality index; and identifying whether the normality index is normal or abnormal, wherein a normal state is characterized by the presence of a minimum percentage of pCDR3 and an abnormal state is characterized by the absence of a minimum percentage of pCDR3.

In certain embodiments, such second method measures a population of white blood cells, wherein the population includes about 100,000 randomly-selected cells. In certain embodiments, the method is repeated about 10 to 100 times, each time with a random selection of cells, to determine the average percentage of pCDR3 expressed by the patient. In certain embodiments, the minimum percentage of pCDR3 is a percentage number from about 25 to about 75. In certain embodiments, the pCDR3 is composed of at least the 1000 most-frequently-shared CDR3. In certain embodiments, the pCDR3 includes SEQ ID NO:1 through SEQ ID NO: 4014 as described herein. For example, the normality index of a patient may be determined based on the percentage of pCDR3 sequences, represented by SEQ ID NO: 1 through SEQ ID NO: 4014, present in a predetermined number of reads of a patient sample. In certain embodiments, the pCDR3 is composed of CDR3 shared by at least 50 percent of a pool of individuals.

The reference pool of individuals may be different sizes. In certain embodiments, the reference pool includes at least 100 individuals. In certain embodiments, the pool contains about 1000 individuals. In certain embodiments, the pool is composed of healthy control individuals, whereas in other embodiments, the pool is composed of individuals with one or more specific disease states. The reference pool may further be controlled to account for certain variables of a given patient. In certain embodiments, the pool of individuals is approximately age-matched to the patient. In other embodiments, the pool of individuals is gender-matched to the patient.

In various aspects of the present disclosure, the immune system cells that are analyzed, under any method described herein, may include, for example, all T cells [panT], functional subsets of T cells such as CD8+ T cells [cytotoxic T (Ta)], CD4+ T cells and their subsets [TH1, TH2, TH17, regulatory T (reg) and follicular T (TFH)], or developmental subsets of T cells such as naive T (Tn), activated T (Ta), memory T (Tm), all B cells (panB) and their subsets such as naive B (Br), activated B (Ba), memory B (Bm), plasma and plasmablast B cells. Such cells may be obtained from peripheral blood or other sources known in the art.

It will be apparent to those skilled in the art that only the preferred embodiments have been described by way of exemplification and that there are various modifications which fall within the scope of the present disclosure. These and other aspects of the present disclosure will be discussed in greater detail below.

BRIEF DESCRIPTION OF THE DRAWINGS

FIG. 1 shows four plots overlaid into a single graph, representing (from top to bottom) the number of total reads, the number of unique CDR3s, the number of pCDR3s, and the normality index.

DETAILED DESCRIPTION

The inventor has developed a method for determining the diversity of a patient's immunorepertoire by comparing the CDR3 sequences in a patient sample to the most commonly-shared CDR3 sequences (i.e., the pCDR3) of an index group of individuals. This percentage of pCDR3 in a patient's sample is referred to as the "normality index" and may serve as a diagnostic indicator of the immunorepertoire diversity in such patient. The present disclosure further includes a method for determining such subset of highly-shared pCDR3. In one aspect of the present disclosure, the immunorepertoire of a patient is considered normal if the patient's normality index meets or exceeds a minimum percentage, whereas the immunorepertoire of the patient is considered abnormal of the patient's normality index is below such minimum percentage. As used herein, "patient" may refer to either a human or an animal.

The CDR3 expressed by individuals exhibits tremendous diversity, with up to $10^{15}$ unique CDR3 possible. As such, the present disclosure uses CDR3 as a basis for immune system diversity. The inventor has determined, based on a sampling of 75 million CDR3, that approximately 81% of randomly-selected CDR3 are unique to a given individual and are not shared among multiple individuals. The present disclosure, however, provides a method for determining a pool of highly-shared CDR3, thereby enabling a standard index of shared CDR3 by which the diversity of an individual's immunorepertoire may be compared.

As used herein, "abnormal" means the absence of a minimum percentage of pCDR3 sequences measured in a patient. As such, abnormal indicates a difference from the reference group of individuals used to generate the pCDR3. An abnormal immunorepertoire may, but does not necessarily, indicate the presence or absence of disease in the patient.

As used herein, "immunorepertoire" means the set of distinct CDR3 sequences detected in the lymphocytes of an individual or individuals, as applicable.

The method of the present disclosure may be performed using the following steps to identify a normal immune status or an abnormal immune status in a patient, the method comprising the steps of: (a) amplifying polynucleotides from a population of white blood cells from a patient in a reaction mix comprising target-specific nested primers to produce a set of first amplicons, at least a portion of the target-specific nested primers comprising additional nucleotides which, during amplification, serve as a template for incorporating into the first amplicons a binding site for at least one common primer; (b) transferring a portion of the first reaction mix containing the first amplicons to a second reaction mix comprising at least one common primer; (c) amplifying, using the at least one common primer, the first amplicons to produce a set of second amplicons; (d) sequencing the second amplicons to identify CDR3 sequences in the subpopulation of white blood cells, and (e) using the identified CDR3 sequences to quantify the percentage of pCDR3 represented by the sample to provide a normality index; and (f) identifying whether the normality index is normal or abnormal, wherein a normal state is characterized by the presence of a minimum percentage of pCDR3 and an abnormal state is characterized by the absence of a minimum percentage of pCDR3. As shown in FIG. 1, a patient's normality index, pCDR3s and unique CDR3s are correlated.

In certain embodiments, the sequencing includes about 100,000 reads taken per sample. In certain embodiments, the reads are performed multiple times, for example about 10 to 100 times, using random selection, to obtain an average percentage of pCDR3 sequences present in the sample. The resulting number is divided by the number of pCDR3 in the reference pool to obtain a percentage, referred to as the "normality index," which is a number between 0% and 100%. For example, if a patient sample contains 400 of 1000 pCDR3 sequences, then the patient's normality index is 0.40 or 40%. In other embodiments at least 10,000 reads are taken. In other embodiments, more than 100,000 reads are taken. In other embodiments, the reads are performed less than 10 times. In other embodiments, the reads are performed more than 100 times.

In certain embodiments, the index pool is composed of about 1000 individuals. In other embodiments, the index pool contains between 100 and 1000 individuals. In other embodiments, the index pool contains fewer than 100 individuals. In other embodiments, the index pool contains more than 1000 individuals. Relative to the patient, the individuals may be age-matched, gender-matched, healthy, disease-matched, and/or other criteria commonly known in the art when controlling for variables. In certain embodiments, the index pool is composed of healthy controls. In other embodiments, the index pool is composed of a mix of healthy controls and individuals with one or more disease states. In other embodiments, the index pool is composed of individuals with one or more particular disease states.

In certain embodiments, the CDR3 sequences shared by the index pool (i.e., the pCDR3) are determined by comparing each sample from the index pool and identifying those CDR3s that are shared by at least 50% of the individuals tested in such reference pool. In certain embodiments, the pCDR3 includes about the top 1000 shared CDR3 sequences. In other embodiments, the pCDR3 include at least 100 CDR3 sequences. In other embodiments, the pCDR3 includes more than 1000 CDR3 sequences.

In certain embodiments, the minimum percentage of pCDR3, used to determine the normal or abnormal state of the immunorepertoire, is about 25%. In other embodiments, the minimum percentage of pCDR3 is between 25% and 75%.

It has previously been difficult to assess the immune system in a broad manner, because the number and variety of cells in a human or animal immune system is so large that sequencing of more than a small subset of cells has been almost impossible. The inventor developed a semi-quantitative PCR method (arm-PCR, described in more detail in U.S. Patent Application Publication Number 20090253183), which provides increased sensitivity and specificity over previously-available methods, while producing semi-quantitative results. It is this ability to increase specificity and sensitivity, and thereby increase the number of targets detectable within a single sample that makes the method ideal for detecting relative numbers of clonotypes of the immunorepertoire. The inventor has more recently discovered that using this sequencing method allows comparison of a patient's CDR3 sequences to those commonly shared by an index group, which has led to the development of the present method. The method may be used to evaluate the diversity of the immunorepertoire of subjects relative to an index pool of individuals. For example, the inventor has demonstrated that the presence of disease correlates with decreased immunorepertoire diversity, for example a decrease in the diversity of CDR3 sequences, which can be readily detected using the method of the present disclosure. This method may therefore be useful as an initial diagnostic indicator, much as cell counts and biochemical tests are currently used in clinical practice, of normal versus abnormal immunorepertoire diversity.

Clonotypes (i.e., clonal types) of an immunorepertoire are determined by the rearrangement of Variable (V), Diverse (D) and Joining (J) gene segments through somatic recombination in the early stages of immunoglobulin (Ig) and T cell receptor (TCR) production of the immune system. The V(D)J rearrangement can be amplified and detected from T cell receptor alpha, beta, gamma, and delta chains, as well as from immunoglobulin heavy chain (IgH) and light chains (IgK, IgL). Cells may be obtained from a patient by obtaining peripheral blood, lymphoid tissue, cancer tissue, or tissue or fluids from other organs and/or organ systems, for example. Techniques for obtaining these samples, such as blood samples, are known to those of skill in the art. Cell counts may be extrapolated from the number of sequences detected by PCR amplification and sequencing.

The CDR3 region, comprising about 30-90 nucleotides, encompasses the junction of the recombined variable (V), diversity (D) and joining (J) segments of the gene. It encodes the binding specificity of the receptor and is useful as a sequence tag to identify unique V(D)J rearrangements.

Wang et al. disclosed that PCR may be used to obtain quantitative or semi-quantitative assessments of the numbers of target molecules in a specimen (Wang, M. et al, "Quantitation of mRNA by the polymerase chain reaction," (1989) Proc. Nat'l. Acad. Sci. 86: 9717-9721). Particularly effective methods for achieving quantitative amplification have been described previously by the inventor. One such method is known as arm-PCR, which is described in United States Patent Application Publication Number 20090253183A1.

Aspects of the present disclosure include arm-PCR amplification of CDR3 from T cells, B cells, and/or subsets of T or B cells. Such cell types may be sorted and isolated using techniques known in the art including, but not limited to, FACS sorting and magnetic bead sorting. The term "population" of cells, as used herein, therefore encompasses what are generally referred to as either "populations" or "subpopulations" of cells. Large numbers of amplified products may then be efficiently sequenced using next-generation sequencing using platforms such as 454 or Illumina, for example.

The arm-PCR method provides highly sensitive, semi-quantitative amplification of multiple polynucleotides in one reaction. The arm-PCR method may also be performed by automated methods in a closed cassette system (iCubate®, Huntsville, Ala.), which is beneficial in the present method because the repertoires of various T and B cells, for example, are so large. In the arm-PCR method, target numbers are increased in a reaction driven by DNA polymerase, which is the result of target-specific primers being introduced into the reaction. An additional result of this amplification reaction is the introduction of binding sites for common primers which will be used in a subsequent amplification by transferring a portion of the first reaction mix containing the first set of amplicons to a second reaction mix comprising common primers. "At least one common primer," as used herein, refers to at least one primer that will bind to such a binding site, and includes pairs of primers, such as forward and reverse primers. This transfer may be performed either by recovering a portion of the reaction mix from the first amplification reaction and introducing that sample into a second reaction tube or chamber, or by removing a portion of the liquid from the completed first amplification, leaving behind a portion, and adding fresh reagents into the tube in which the first amplification was performed. In either case, additional buffers, polymerase, etc., may then be added in conjunction with the common primers to produce amplified products for detection. The amplification of target molecules using common primers gives a semi-quantitative result wherein the quantitative numbers of targets amplified in the first amplification are amplified using common, rather than target-specific primers—making it possible to produce significantly higher numbers of targets for detection and to determine the relative amounts of the cells comprising various rearrangements within a patient blood sample. Also, combining the second reaction mix with a portion of the first reaction mix allows for higher concentrations of target-specific primers to be added to the first reaction mix, resulting in greater sensitivity in the first amplification reaction. It is the combination of specificity and sensitivity, along with the ability to achieve quantitative results by use of a method such as the arm-PCR method, which allows a sufficiently sensitive and quantitative assessment of the CDR3 expressed in a population of cells to produce a normality index that is of diagnostic use.

Clonal expansion due to recognition of antigen results in a larger population of cells that recognize that antigen, potentially including antibody-producing B cells or receptor-bearing T cells. This may cause the reads taken pursuant to the method disclosed herein to be biased in favor of the antigen-specific expansion, thereby reducing the percentage of pCDR3 sequences detected. Therefore, a relatively low normality index, for example one below the minimum percentage, may be indicative of the expansion of a particular population of cells that is prevalent in individuals who have been diagnosed with a particular disease or in individuals recently-vaccinated against a particular antigen.

Primers for amplifying and sequencing variable regions of immune system cells are available commercially, and have been described in publication such as the inventor's published patent applications WO2009137255 and US201000021896A1.

There are several commercially available high-throughput sequencing technologies, such as Hoffman-LaRoche, Inc.'s 454® sequencing system. In the 454® sequencing method, for example, the A and B adaptor are linked onto PCR products either during PCR or ligated on after the PCR reaction. The adaptors are used for amplification and sequencing steps. When done in conjunction with the arm-PCR technique, A and B adaptors may be used as common primers (which are sometimes referred to as "communal primers" or "superprimers") in the amplification reactions. After A and B adaptors have been physically attached to a sample library (such as PCR amplicons), a single-stranded DNA library is prepared using techniques known to those of skill in the art. The single-stranded DNA library is immobilized onto specifically-designed DNA capture beads. Each bead carries a unique singled-stranded DNA library fragment. The bead-bound library is emulsified with amplification reagents in a water-in-oil mixture, producing microreactors, each containing just one bead with one unique sample-library fragment. Each unique sample library fragment is amplified within its own microreactor, excluding competing or contaminating sequences. Amplification of the entire fragment collection is done in parallel. For each fragment, this results in copy numbers of several million per bead. Subsequently, the emulsion PCR is broken while the amplified fragments remain bound to their specific beads. The clonally amplified fragments are enriched and loaded onto a PicoTiterPlate® device for sequencing. The diameter of the PicoTiterPlate® wells allows for only one bead per well. After addition of sequencing enzymes, the fluidics subsystem of the sequencing instrument flows individual nucleotides in a fixed order across the hundreds of thousands of wells each containing a single bead. Addition of one (or more) nucleotide(s) complementary to the template strand results in a chemilluminescent signal recorded by a CCD camera within the instrument. The combination of signal intensity and positional information generated across the PicoTiterPlate® device allows the software to determine the sequence of more than 1,000,000 individual reads, each is up to about 450 base pairs, with the GS FLX system.

Having obtained the sequences using a quantitative and/or semi-quantitative method, it is then possible to calculate the normality index, for example, by determining the percentage of pCDR3 represented by a predetermined number of reads of a patient sample. Each patient's normality index may be compared to a predetermined threshold to determine whether the patient's normality index falls within the normal range, and therefore is normal, or below the threshold, and thereby is abnormal.

The method of the present disclosure provides a physician with an additional clinical test for diagnostic purposes to determine whether a patient's immunorepertoire is abnormal. Further, the method of the present disclosure, particularly if used in an automated system such as that described by the inventor in U.S. Patent Application Publication Number 201000291668A1, may be used to analyze samples from multiple patients, with detection of the amplified targets sequences being accomplished by the use of one or more microarrays.

EXAMPLES

Patient Samples

Whole blood samples (40 ml) collected in sodium heparin or peripheral blood mononuclear cells (PBMCs) were obtained from 1100 individuals, representing a mixed population of both healthy individuals and those with disease. The 1100 individuals were placed randomly into 11 different groups with 100 samples per group.

RNA Extraction and Repertoire Amplification

RNA extraction was performed using the RNeasy Mini Kit (Qiagen) according to the manufacturer's protocol. For each target, a set of nested sequence-specific primers (Forward-out, Fo; Forward-in, Fi; Reverse-out, Ro; and Reverse-in, Ri) was designed using primer software available at irepertoire.com. A pair of common sequence tags was linked to all internal primers (Fi and Ri). Once these tag sequences were incorporated into the PCR products in the first few amplification cycles, the exponential phase of the amplification was carried out with a pair of communal primers. In the first round of amplification, only sequence-specific nested primers were used. The nested primers were then removed by exonuclease digestion and the first-round PCR products were used as templates for a second round of amplification by adding communal primers and a mixture of fresh enzyme and dNTP. Each distinct barcode tag was introduced into amplicon from the same sample through PCR primer.

Sequencing

Barcode tagged amplicon products from different samples were pooled together and loaded into a 2% agarose gel. Following electrophoresis, DNA fragments were purified from DNA band corresponding to 250-500 bp fragments extracted from agarose gel. DNA was sequenced using the 454 GS FLX system with titanium kits (SeqWright, Inc.).

Sequencing Data Analysis

Sequences for each sample were sorted out according to barcode tag. Following sequence separation, sequence analysis was performed in a manner similar to the approach reported by Wang et al. (Wang C, et al. High throughput sequencing reveals a complex pattern of dynamic interrelationships among human T cell subsets. Proc Natl Acad Sci USA 107(4): 1518-1523). Briefly, germline V and J reference sequences, which were downloaded from the IMGT server (imgt.org), were mapped onto sequence reads using the program IRmap. The boundaries defining CDR3 region in reference sequences were mirrored onto sequencing reads through mapping information. The enclosed CDR3 regions in sequencing reads were extracted and translated into amino acid sequence.

Determination of pCDR3

Sequences obtained from each of the 11 groups were compared to determine which CDR3 sequences were detected in at least 50% of the samples in each group. The resulting CDR3 sequences were sorted such that the top 4014 most commonly shared CDR3 sequences were selected as the pCDR3 for purposes of calculating a normality index for patient samples. The CDR3 sequences selected for inclusion in the pCDR3—SEQ ID NO:1 through SEQ ID NO: 4014—are shown in Table I.

TABLE I

| Sequence | Sequence ID No |
|---|---|
| ASSLGETQY | SEQ ID NO: 1 |
| ASSLSTDTQY | SEQ ID NO: 2 |

TABLE I-continued

| Sequence | Sequence ID No |
|---|---|
| ASSLGTDTQY | SEQ ID NO: 3 |
| ASSPSTDTQY | SEQ ID NO: 4 |
| ASSLQETQY | SEQ ID NO: 5 |
| ASSLTDTQY | SEQ ID NO: 6 |
| ASSLGYEQY | SEQ ID NO: 7 |
| ASSLGDTQY | SEQ ID NO: 8 |
| ASSLGGNTEAF | SEQ ID NO: 9 |
| ASSLGGNQPQH | SEQ ID NO: 10 |
| ASSLEETQY | SEQ ID NO: 11 |
| ASSLDSNQPQH | SEQ ID NO: 12 |
| ASSLGQNTEAF | SEQ ID NO: 13 |
| ASSLRETQY | SEQ ID NO: 14 |
| ASSLADTQY | SEQ ID NO: 15 |
| ASSLSYEQY | SEQ ID NO: 16 |
| ASSLGSNQPQH | SEQ ID NO: 17 |
| ASSSSYEQY | SEQ ID NO: 18 |
| ASSSQETQY | SEQ ID NO: 19 |
| ASSPQETQY | SEQ ID NO: 20 |
| ASSLGGTEAF | SEQ ID NO: 21 |
| ASSSTDTQY | SEQ ID NO: 22 |
| ASSLGGTDTQY | SEQ ID NO: 23 |
| ASSLQGNTEAF | SEQ ID NO: 24 |
| ASSLAGGTDTQY | SEQ ID NO: 25 |
| ASSLGNTEAF | SEQ ID NO: 26 |
| ASSFGETQY | SEQ ID NO: 27 |
| ASSLGGYEQY | SEQ ID NO: 28 |
| ASSLGLNTEAF | SEQ ID NO: 29 |
| ASSLGSTDTQY | SEQ ID NO: 30 |
| ASSLTGNTEAF | SEQ ID NO: 31 |
| ASSLGRNTEAF | SEQ ID NO: 32 |
| ASSPSYEQY | SEQ ID NO: 33 |
| ASSPSSYEQY | SEQ ID NO: 34 |
| ASSLYNEQF | SEQ ID NO: 35 |
| ASSLGVNTEAF | SEQ ID NO: 36 |
| ASSSSTDTQY | SEQ ID NO: 37 |
| ASSLAGTDTQY | SEQ ID NO: 38 |
| ASSFTDTQY | SEQ ID NO: 39 |
| ASSLGQGYEQY | SEQ ID NO: 40 |
| ASSLGNEQF | SEQ ID NO: 41 |
| ASSLGTEAF | SEQ ID NO: 42 |
| ASSPGTDTQY | SEQ ID NO: 43 |
| ASSLSSYEQY | SEQ ID NO: 44 |
| ASSLDSYEQY | SEQ ID NO: 45 |
| ASSLGSYEQY | SEQ ID NO: 46 |
| ASSLDRNTEAF | SEQ ID NO: 47 |
| ASSLNTEAF | SEQ ID NO: 48 |
| ASSSYNEQF | SEQ ID NO: 49 |
| ASSPGETQY | SEQ ID NO: 50 |
| ASSLGGSTDTQY | SEQ ID NO: 51 |
| ASSLGGNEQF | SEQ ID NO: 52 |
| ASSQGYEQY | SEQ ID NO: 53 |
| ASSLSDTQY | SEQ ID NO: 54 |
| ASSLTVNTEAF | SEQ ID NO: 55 |
| ASSPPSTDTQY | SEQ ID NO: 56 |
| ASSLAGNTEAF | SEQ ID NO: 57 |
| ASSLGGSYEQY | SEQ ID NO: 58 |
| ASSPGQGYEQY | SEQ ID NO: 59 |
| ASSLGQGNTEAF | SEQ ID NO: 60 |
| ASSLGGSNQPQH | SEQ ID NO: 61 |
| ASSFQETQY | SEQ ID NO: 62 |
| ASSLQGYEQY | SEQ ID NO: 63 |
| ASSLGADTQY | SEQ ID NO: 64 |
| ASSLTGGTEAF | SEQ ID NO: 65 |
| ASSLGQGNQPQH | SEQ ID NO: 66 |
| ASSLGSSYEQY | SEQ ID NO: 67 |
| ASSLGSYNEQF | SEQ ID NO: 68 |
| ASSLGGSSYEQY | SEQ ID NO: 69 |
| ASSLAGYEQY | SEQ ID NO: 70 |
| ASSLAGSTDTQY | SEQ ID NO: 71 |
| ASSLKETQY | SEQ ID NO: 72 |
| ASSLGGGTEAF | SEQ ID NO: 73 |
| ASSRDSNQPQH | SEQ ID NO: 74 |
| ASSLGPNTEAF | SEQ ID NO: 75 |
| ASSLGGDTQY | SEQ ID NO: 76 |
| ASSSSSYEQY | SEQ ID NO: 77 |
| ASSLGNQPQH | SEQ ID NO: 78 |
| ASSSTYEQY | SEQ ID NO: 79 |
| ASSLGGGTDTQY | SEQ ID NO: 80 |

TABLE I-continued

| Sequence | Sequence ID No |
|---|---|
| ASSLSSYNEQF | SEQ ID NO: 81 |
| ASSFSTDTQY | SEQ ID NO: 82 |
| ASSLGMNTEAF | SEQ ID NO: 83 |
| ASSPDSYEQY | SEQ ID NO: 84 |
| ASSPGYEQY | SEQ ID NO: 85 |
| ASSPRTDTQY | SEQ ID NO: 86 |
| ASSLDTDTQY | SEQ ID NO: 87 |
| ASSLGGETQY | SEQ ID NO: 88 |
| ASSRQETQY | SEQ ID NO: 89 |
| ASSLAETQY | SEQ ID NO: 90 |
| ASSLGQGAYEQY | SEQ ID NO: 91 |
| ASSLNSNQPQH | SEQ ID NO: 92 |
| ASSLQGNQPQH | SEQ ID NO: 93 |
| ASSRTDTQY | SEQ ID NO: 94 |
| ASSLNTGELF | SEQ ID NO: 95 |
| ASSLGQGTDTQY | SEQ ID NO: 96 |
| ASSLGQNYGYT | SEQ ID NO: 97 |
| ASSLSGNTEAF | SEQ ID NO: 98 |
| ASSLSSNQPQH | SEQ ID NO: 99 |
| ASSLTGNQPQH | SEQ ID NO: 100 |
| ASSPQGYEQY | SEQ ID NO: 101 |
| ASSLSETQY | SEQ ID NO: 102 |
| ASSLGGEQY | SEQ ID NO: 103 |
| ASSLGYNEQF | SEQ ID NO: 104 |
| ASSLRDTQY | SEQ ID NO: 105 |
| ASSFSYEQY | SEQ ID NO: 106 |
| ASSLRGNTEAF | SEQ ID NO: 107 |
| ASSLGGSYNEQF | SEQ ID NO: 108 |
| ASSPGQNTEAF | SEQ ID NO: 109 |
| ASSLAGGYNEQF | SEQ ID NO: 110 |
| ASSSGYEQY | SEQ ID NO: 111 |
| ASSPTGNTEAF | SEQ ID NO: 112 |
| ASSLGQETQY | SEQ ID NO: 113 |
| ASSLAYEQY | SEQ ID NO: 114 |
| ASSLSGYEQY | SEQ ID NO: 115 |
| ASSLTYEQY | SEQ ID NO: 116 |
| ASSLDSYNEQF | SEQ ID NO: 117 |
| ASSLEGNQPQH | SEQ ID NO: 118 |
| ASSLGQQETQY | SEQ ID NO: 119 |
| ASSYTDTQY | SEQ ID NO: 120 |
| ASSFGGNTEAF | SEQ ID NO: 121 |
| ASSLVGYEQY | SEQ ID NO: 122 |
| ASSPYNEQF | SEQ ID NO: 123 |
| ASSLEGNTEAF | SEQ ID NO: 124 |
| ASSLGGYNEQF | SEQ ID NO: 125 |
| ASSLVGNTEAF | SEQ ID NO: 126 |
| ASSLEGYEQY | SEQ ID NO: 127 |
| ASSLGQLNTEAF | SEQ ID NO: 128 |
| ASSPGDTQY | SEQ ID NO: 129 |
| ASSLAGNQPQH | SEQ ID NO: 130 |
| ASSSGETQY | SEQ ID NO: 131 |
| ASSLGGQETQY | SEQ ID NO: 132 |
| ASSPNTDTQY | SEQ ID NO: 133 |
| ASSPGGTEAF | SEQ ID NO: 134 |
| ASSLNYEQY | SEQ ID NO: 135 |
| ASSSQGYEQY | SEQ ID NO: 136 |
| ASSLVETQY | SEQ ID NO: 137 |
| ASSLGENTEAF | SEQ ID NO: 138 |
| ASSPGGYEQY | SEQ ID NO: 139 |
| ASSLAGSYEQY | SEQ ID NO: 140 |
| ASSLSGANVLT | SEQ ID NO: 141 |
| ASSPQGNTEAF | SEQ ID NO: 142 |
| ASSLLETQY | SEQ ID NO: 143 |
| ASSRGYEQY | SEQ ID NO: 144 |
| ASSLLNTEAF | SEQ ID NO: 145 |
| ASSLGPYEQY | SEQ ID NO: 146 |
| ASSYQETQY | SEQ ID NO: 147 |
| ASSYSYEQY | SEQ ID NO: 148 |
| ASSLAGGTEAF | SEQ ID NO: 149 |
| ASSLQGTDTQY | SEQ ID NO: 150 |
| ASSLRGTDTQY | SEQ ID NO: 151 |
| ASSLNTDTQY | SEQ ID NO: 152 |
| ASSLGANTEAF | SEQ ID NO: 153 |
| ASSPGLNTEAF | SEQ ID NO: 154 |
| ASSLGQGSYEQY | SEQ ID NO: 155 |
| ASSFRETQY | SEQ ID NO: 156 |
| ASSLTANTEAF | SEQ ID NO: 157 |
| ASSLNNEQF | SEQ ID NO: 158 |

TABLE I-continued

| Sequence | Sequence ID No |
|---|---|
| ASSFGDTQY | SEQ ID NO: 159 |
| ASSRQGNTEAF | SEQ ID NO: 160 |
| ASSLTENTEAF | SEQ ID NO: 161 |
| ASSLTTDTQY | SEQ ID NO: 162 |
| ASSRTGNTEAF | SEQ ID NO: 163 |
| ASSLGGQPQH | SEQ ID NO: 164 |
| ASSLTGYEQY | SEQ ID NO: 165 |
| ASSQQETQY | SEQ ID NO: 166 |
| ASSSAYEQY | SEQ ID NO: 167 |
| ASSLDGNTEAF | SEQ ID NO: 168 |
| ASSLGQSYEQY | SEQ ID NO: 169 |
| ASSLAGGYEQY | SEQ ID NO: 170 |
| ASSPTTDTQY | SEQ ID NO: 171 |
| ASSPDRNTEAF | SEQ ID NO: 172 |
| ASSLGGSSYNEQF | SEQ ID NO: 173 |
| ASSLGGYGYT | SEQ ID NO: 174 |
| ASSFGTDTQY | SEQ ID NO: 175 |
| ASSLASTDTQY | SEQ ID NO: 176 |
| ASSLGQSTDTQY | SEQ ID NO: 177 |
| ASSRSTDTQY | SEQ ID NO: 178 |
| ASSLDSTDTQY | SEQ ID NO: 179 |
| ASSSQGNTEAF | SEQ ID NO: 180 |
| ASSFGYEQY | SEQ ID NO: 181 |
| ASSLGTANTEAF | SEQ ID NO: 182 |
| ASSSPYEQY | SEQ ID NO: 183 |
| ASSLAGQETQY | SEQ ID NO: 184 |
| ASSLSNQPQH | SEQ ID NO: 185 |
| ASSLVGTDTQY | SEQ ID NO: 186 |
| ASSLVTDTQY | SEQ ID NO: 187 |
| ASSLSGNTIY | SEQ ID NO: 188 |
| ASSLGGGNQPQH | SEQ ID NO: 189 |
| ASSLRTDTQY | SEQ ID NO: 190 |
| ASSPGQGNQPQH | SEQ ID NO: 191 |
| ASSLMNTEAF | SEQ ID NO: 192 |
| ASSLSGSTDTQY | SEQ ID NO: 193 |
| ASSPRETQY | SEQ ID NO: 194 |
| ASSPDSNQPQH | SEQ ID NO: 195 |
| ASSSYTDTQY | SEQ ID NO: 196 |
| ASSLTSTDTQY | SEQ ID NO: 197 |
| ASSPGQGNTEAF | SEQ ID NO: 198 |
| ASSPGQGAYEQY | SEQ ID NO: 199 |
| ASSRNTEAF | SEQ ID NO: 200 |
| ASSQSYEQY | SEQ ID NO: 201 |
| ASSSGTDTQY | SEQ ID NO: 202 |
| ASSLGQGYGYT | SEQ ID NO: 203 |
| ASSQGETQY | SEQ ID NO: 204 |
| ASSPGQGTDTQY | SEQ ID NO: 205 |
| ASSYSTDTQY | SEQ ID NO: 206 |
| ASSLGQMNTEAF | SEQ ID NO: 207 |
| ASSLQGGTEAF | SEQ ID NO: 208 |
| ASSLVGETQY | SEQ ID NO: 209 |
| ASSLAGSYNEQF | SEQ ID NO: 210 |
| ASSRDSYEQY | SEQ ID NO: 211 |
| ASSRDSQETQY | SEQ ID NO: 212 |
| ASSLDYEQY | SEQ ID NO: 213 |
| ASSLDGNQPQH | SEQ ID NO: 214 |
| ASSRYNEQF | SEQ ID NO: 215 |
| ASSLGLQETQY | SEQ ID NO: 216 |
| ASSFSDTQY | SEQ ID NO: 217 |
| ASSPGTGSYEQY | SEQ ID NO: 218 |
| ASSLSGNQPQH | SEQ ID NO: 219 |
| ASSDSYEQY | SEQ ID NO: 220 |
| ASSLGDTEAF | SEQ ID NO: 221 |
| ASSLAGDTQY | SEQ ID NO: 222 |
| ASSRSYEQY | SEQ ID NO: 223 |
| ASSLVGNEQF | SEQ ID NO: 224 |
| ASSLGQTYEQY | SEQ ID NO: 225 |
| ASSPGGTDTQY | SEQ ID NO: 226 |
| ASSPGQGSYEQY | SEQ ID NO: 227 |
| ASSLAGETQY | SEQ ID NO: 228 |
| ASSLRGTEAF | SEQ ID NO: 229 |
| ASSPGSYEQY | SEQ ID NO: 230 |
| ASSLSRNTEAF | SEQ ID NO: 231 |
| ASSPGQQETQY | SEQ ID NO: 232 |
| ASSLGTGELF | SEQ ID NO: 233 |
| ASSLGGEQF | SEQ ID NO: 234 |
| ASSLYSNQPQH | SEQ ID NO: 235 |
| ASSPTDTQY | SEQ ID NO: 236 |

TABLE I-continued

| Sequence | Sequence ID No |
|---|---|
| ASSLAGNEQF | SEQ ID NO: 237 |
| ASSPGTGGYEQY | SEQ ID NO: 238 |
| ASSLATDTQY | SEQ ID NO: 239 |
| ASSRDSSYEQY | SEQ ID NO: 240 |
| ASSPGTANTEAF | SEQ ID NO: 241 |
| ASSLGPDTQY | SEQ ID NO: 242 |
| ASSLAVNTEAF | SEQ ID NO: 243 |
| ASSLEDTQY | SEQ ID NO: 244 |
| ASSLGGADTQY | SEQ ID NO: 245 |
| ASSLGSSYNEQF | SEQ ID NO: 246 |
| ASSLAGGSYEQY | SEQ ID NO: 247 |
| ASSRDRNTEAF | SEQ ID NO: 248 |
| ASSSDSYEQY | SEQ ID NO: 249 |
| ASSLEVNTEAF | SEQ ID NO: 250 |
| ASSLSGSSYNEQF | SEQ ID NO: 251 |
| ASSLSSTDTQY | SEQ ID NO: 252 |
| ASSLGTSTDTQY | SEQ ID NO: 253 |
| ASSLGTGSYEQY | SEQ ID NO: 254 |
| ASSLVADTQY | SEQ ID NO: 255 |
| ASSLSYNEQF | SEQ ID NO: 256 |
| ASSLGGMNTEAF | SEQ ID NO: 257 |
| ASSSGSYEQY | SEQ ID NO: 258 |
| ASSLDGYEQY | SEQ ID NO: 259 |
| ASSLSGTDTQY | SEQ ID NO: 260 |
| ASSLGSDTQY | SEQ ID NO: 261 |
| ASSQGLNTEAF | SEQ ID NO: 262 |
| ASSLVDTQY | SEQ ID NO: 263 |
| ASSLGAYEQY | SEQ ID NO: 264 |
| ASSLDRNQPQH | SEQ ID NO: 265 |
| ASSLGTYEQY | SEQ ID NO: 266 |
| ASSLVNTEAF | SEQ ID NO: 267 |
| ASSLSVNTEAF | SEQ ID NO: 268 |
| ASSAQETQY | SEQ ID NO: 269 |
| ASSLVNEQF | SEQ ID NO: 270 |
| ASSLRGYEQY | SEQ ID NO: 271 |
| ASSLTGGNTEAF | SEQ ID NO: 272 |
| ASSLDSSYEQY | SEQ ID NO: 273 |
| ASSLAGADTQY | SEQ ID NO: 274 |
| ASSLAGGPYEQY | SEQ ID NO: 275 |
| ASSPGTGNQPQH | SEQ ID NO: 276 |
| ASSPGLQETQY | SEQ ID NO: 277 |
| ASSTSTDTQY | SEQ ID NO: 278 |
| ASSLDRGTDTQY | SEQ ID NO: 279 |
| ASSLQENTEAF | SEQ ID NO: 280 |
| ASSSLYEQY | SEQ ID NO: 281 |
| ASSPGNTEAF | SEQ ID NO: 282 |
| ASSQDSNQPQH | SEQ ID NO: 283 |
| ASSLTGSYEQY | SEQ ID NO: 284 |
| ASSLAGSSYEQY | SEQ ID NO: 285 |
| ASSFGSNQPQH | SEQ ID NO: 286 |
| ASSLGGSGNTIY | SEQ ID NO: 287 |
| ASSLSLNTEAF | SEQ ID NO: 288 |
| ASSNTDTQY | SEQ ID NO: 289 |
| ASSRTVNTEAF | SEQ ID NO: 290 |
| ASSPAYEQY | SEQ ID NO: 291 |
| ASSPTVNTEAF | SEQ ID NO: 292 |
| ASSRGETQY | SEQ ID NO: 293 |
| ASSLVGTEAF | SEQ ID NO: 294 |
| ASSRDRQETQY | SEQ ID NO: 295 |
| ASSLGGLNTEAF | SEQ ID NO: 296 |
| ASSFGGTEAF | SEQ ID NO: 297 |
| ASSQETQY | SEQ ID NO: 298 |
| ASSLSGSYEQY | SEQ ID NO: 299 |
| ASSPEETQY | SEQ ID NO: 300 |
| ASSPGGNTEAF | SEQ ID NO: 301 |
| ASSLLDTQY | SEQ ID NO: 302 |
| ASSLLTDTQY | SEQ ID NO: 303 |
| ASSSYYEQY | SEQ ID NO: 304 |
| ASSQSTDTQY | SEQ ID NO: 305 |
| ASSFGNTEAF | SEQ ID NO: 306 |
| ASSLTGDTEAF | SEQ ID NO: 307 |
| ASSPSSYNEQF | SEQ ID NO: 308 |
| ASSFGGTDTQY | SEQ ID NO: 309 |
| ASSSDRNTEAF | SEQ ID NO: 310 |
| ASSQDRNTEAF | SEQ ID NO: 311 |
| ASSLGLYNEQF | SEQ ID NO: 312 |
| ASSLTGGNQPQH | SEQ ID NO: 313 |
| ASSLGGNYGYT | SEQ ID NO: 314 |

TABLE I-continued

| Sequence | Sequence ID No |
|---|---|
| ASSPPTDTQY | SEQ ID NO: 315 |
| ASSLAGGQETQY | SEQ ID NO: 316 |
| ASSLTGTDTQY | SEQ ID NO: 317 |
| ASSLGQAYEQY | SEQ ID NO: 318 |
| ASSRDSTDTQY | SEQ ID NO: 319 |
| ASSPTGYEQY | SEQ ID NO: 320 |
| ASSLQGSNQPQH | SEQ ID NO: 321 |
| ASSLTGGTDTQY | SEQ ID NO: 322 |
| ASSYGETQY | SEQ ID NO: 323 |
| ASSPYTDTQY | SEQ ID NO: 324 |
| ASSLDLNTEAF | SEQ ID NO: 325 |
| ASSLTGSNQPQH | SEQ ID NO: 326 |
| ASSLSNEQF | SEQ ID NO: 327 |
| ASSLGTNTEAF | SEQ ID NO: 328 |
| ASSPGADTQY | SEQ ID NO: 329 |
| ASSLTGNYGYT | SEQ ID NO: 330 |
| ASSLAGSNQPQH | SEQ ID NO: 331 |
| ASSSTGNTEAF | SEQ ID NO: 332 |
| ASSLSGGTDTQY | SEQ ID NO: 333 |
| ASSPNTEAF | SEQ ID NO: 334 |
| ASSLGYGYT | SEQ ID NO: 335 |
| ASSLAGGNTEAF | SEQ ID NO: 336 |
| ASSQGGNTEAF | SEQ ID NO: 337 |
| ASSRDRGYEQY | SEQ ID NO: 338 |
| ASSRGTDTQY | SEQ ID NO: 339 |
| ASSLRNTEAF | SEQ ID NO: 340 |
| ASSSRETQY | SEQ ID NO: 341 |
| ASSLGQPQH | SEQ ID NO: 342 |
| ASSLVGDTQY | SEQ ID NO: 343 |
| ASSLTETQY | SEQ ID NO: 344 |
| ASSLGTVNTEAF | SEQ ID NO: 345 |
| ASSQGTDTQY | SEQ ID NO: 346 |
| ASSFYNEQF | SEQ ID NO: 347 |
| ASSSGSTDTQY | SEQ ID NO: 348 |
| ASSLDTEAF | SEQ ID NO: 349 |
| ASSLEGGTEAF | SEQ ID NO: 350 |
| ASSLGLSTDTQY | SEQ ID NO: 351 |
| ASSLGDQPQH | SEQ ID NO: 352 |
| ASSLRENTEAF | SEQ ID NO: 353 |
| ASSLALNTEAF | SEQ ID NO: 354 |
| ASSVTDTQY | SEQ ID NO: 355 |
| ASSLDQETQY | SEQ ID NO: 356 |
| ASSLSGSSYEQY | SEQ ID NO: 357 |
| ASSPKETQY | SEQ ID NO: 358 |
| ASSLSQETQY | SEQ ID NO: 359 |
| ASSLAQETQY | SEQ ID NO: 360 |
| ASSLQNTEAF | SEQ ID NO: 361 |
| ASSLRNEQF | SEQ ID NO: 362 |
| ASSLSGGTEAF | SEQ ID NO: 363 |
| ASSPGGETQY | SEQ ID NO: 364 |
| ASSRDSYNEQF | SEQ ID NO: 365 |
| ASSSSYNEQF | SEQ ID NO: 366 |
| ASSRQGYEQY | SEQ ID NO: 367 |
| ASSLAENTEAF | SEQ ID NO: 368 |
| ASSLYTDTQY | SEQ ID NO: 369 |
| ASSLGQYNEQF | SEQ ID NO: 370 |
| ASSLTLNTEAF | SEQ ID NO: 371 |
| ASSLAGAYEQY | SEQ ID NO: 372 |
| ASSLGGGNTEAF | SEQ ID NO: 373 |
| ASSLQVNTEAF | SEQ ID NO: 374 |
| ASSLAGSSYNEQF | SEQ ID NO: 375 |
| ASSLRGNQPQH | SEQ ID NO: 376 |
| ASSLDRGYEQY | SEQ ID NO: 377 |
| ASSPPGTDTQY | SEQ ID NO: 378 |
| ASSLGTGNQPQH | SEQ ID NO: 379 |
| ASSSRTDTQY | SEQ ID NO: 380 |
| ASSLRVNTEAF | SEQ ID NO: 381 |
| ASSLAGGSYNEQF | SEQ ID NO: 382 |
| ASSPGTGAYEQY | SEQ ID NO: 383 |
| ASSPGSNQPQH | SEQ ID NO: 384 |
| ASSPNTGELF | SEQ ID NO: 385 |
| ASSPGRNTEAF | SEQ ID NO: 386 |
| ASSLTGELF | SEQ ID NO: 387 |
| ASSPDRNYGYT | SEQ ID NO: 388 |
| ASSPGTVNTEAF | SEQ ID NO: 389 |
| ASSLAGGNEQF | SEQ ID NO: 390 |
| ASSQGGTEAF | SEQ ID NO: 391 |
| ASSLDRNYGYT | SEQ ID NO: 392 |

TABLE I-continued

| Sequence | Sequence ID No |
|---|---|
| ASSIQETQY | SEQ ID NO: 393 |
| ASSLGRSYEQY | SEQ ID NO: 394 |
| ASSRGNTEAF | SEQ ID NO: 395 |
| ASSLSGETQY | SEQ ID NO: 396 |
| ASSLDNEQF | SEQ ID NO: 397 |
| ASSSGQNTEAF | SEQ ID NO: 398 |
| ASSPGQGYGYT | SEQ ID NO: 399 |
| ASSPDTDTQY | SEQ ID NO: 400 |
| ASSSGDTQY | SEQ ID NO: 401 |
| ASSPGSTDTQY | SEQ ID NO: 402 |
| ASSPGSSYEQY | SEQ ID NO: 403 |
| ASSLGGGYEQY | SEQ ID NO: 404 |
| ASSLDRGTEAF | SEQ ID NO: 405 |
| ASSGSTDTQY | SEQ ID NO: 406 |
| ASRLNTEAF | SEQ ID NO: 407 |
| ASSLEGTDTQY | SEQ ID NO: 408 |
| ASSQGNTEAF | SEQ ID NO: 409 |
| ASSLAGGNQPQH | SEQ ID NO: 410 |
| ASSLGRTDTQY | SEQ ID NO: 411 |
| ASSLGRSTDTQY | SEQ ID NO: 412 |
| ASSLRGNEQF | SEQ ID NO: 413 |
| ASSPGGNQPQH | SEQ ID NO: 414 |
| ASSLLGNTEAF | SEQ ID NO: 415 |
| ASSPGQNYGYT | SEQ ID NO: 416 |
| ASSTTDTQY | SEQ ID NO: 417 |
| ASSQGDTQY | SEQ ID NO: 418 |
| ASSLGGDQPQH | SEQ ID NO: 419 |
| ASSLGTAYEQY | SEQ ID NO: 420 |
| ASSLGTYNEQF | SEQ ID NO: 421 |
| ASSTQETQY | SEQ ID NO: 422 |
| ASSLGPQETQY | SEQ ID NO: 423 |
| ASSQDRETQY | SEQ ID NO: 424 |
| ASSLAADTQY | SEQ ID NO: 425 |
| ASSLLGNEQF | SEQ ID NO: 426 |
| ASSLGQGTEAF | SEQ ID NO: 427 |
| ASSPGQSYEQY | SEQ ID NO: 428 |
| ASSVQETQY | SEQ ID NO: 429 |
| ASSPNQETQY | SEQ ID NO: 430 |
| ASSFSNQPQH | SEQ ID NO: 431 |
| ASSLGRNQPQH | SEQ ID NO: 432 |
| ASSRGTEAF | SEQ ID NO: 433 |
| ASSFGQNTEAF | SEQ ID NO: 434 |
| ASSLGGDTEAF | SEQ ID NO: 435 |
| ASSPTGGNQPQH | SEQ ID NO: 436 |
| ASSLGSNTEAF | SEQ ID NO: 437 |
| ASSPGTAYEQY | SEQ ID NO: 438 |
| ASSPYQETQY | SEQ ID NO: 439 |
| ASSLGGTYEQY | SEQ ID NO: 440 |
| ASSLGLATDTQY | SEQ ID NO: 441 |
| ASSQGRNTEAF | SEQ ID NO: 442 |
| ASSPTGNYGYT | SEQ ID NO: 443 |
| ASSGQGNTEAF | SEQ ID NO: 444 |
| ASSRTENTEAF | SEQ ID NO: 445 |
| ASSLRYEQY | SEQ ID NO: 446 |
| ASSQGSNQPQH | SEQ ID NO: 447 |
| ASSLARNTEAF | SEQ ID NO: 448 |
| ASSLAGYNEQF | SEQ ID NO: 449 |
| ASSLLNEQF | SEQ ID NO: 450 |
| ASSPLTDTQY | SEQ ID NO: 451 |
| ASSLGSGNTIY | SEQ ID NO: 452 |
| ASSRGDTQY | SEQ ID NO: 453 |
| ASSASYEQY | SEQ ID NO: 454 |
| ASSLEGYGYT | SEQ ID NO: 455 |
| ASSFQGNTEAF | SEQ ID NO: 456 |
| ASSSNTEAF | SEQ ID NO: 457 |
| ASSLTGMNTEAF | SEQ ID NO: 458 |
| ASSLGTGNTEAF | SEQ ID NO: 459 |
| ASSFGGSTDTQY | SEQ ID NO: 460 |
| ASSFSSYEQY | SEQ ID NO: 461 |
| ASSFGGNQPQH | SEQ ID NO: 462 |
| ASSLSGNEQF | SEQ ID NO: 463 |
| ASSQYNEQF | SEQ ID NO: 464 |
| ASSLRSTDTQY | SEQ ID NO: 465 |
| ASSLGGTQY | SEQ ID NO: 466 |
| ASSLGASTDTQY | SEQ ID NO: 467 |
| ASSLAGEETQY | SEQ ID NO: 468 |
| ASSFGNQPQH | SEQ ID NO: 469 |
| ASSLTGLNTEAF | SEQ ID NO: 470 |

TABLE I-continued

| Sequence | Sequence ID No |
|---|---|
| ASSLGSQETQY | SEQ ID NO: 471 |
| ASSLSGDTQY | SEQ ID NO: 472 |
| ASSLTGSTDTQY | SEQ ID NO: 473 |
| ASSSGNQPQH | SEQ ID NO: 474 |
| ASSSSNQPQH | SEQ ID NO: 475 |
| ASSGYNEQF | SEQ ID NO: 476 |
| ASSLARETQY | SEQ ID NO: 477 |
| ASSLVSYEQY | SEQ ID NO: 478 |
| ASSLAGGPDTQY | SEQ ID NO: 479 |
| ASSLTSGTDTQY | SEQ ID NO: 480 |
| ASSLGRETQY | SEQ ID NO: 481 |
| ASSLGQGGTEAF | SEQ ID NO: 482 |
| ASSLSADTQY | SEQ ID NO: 483 |
| ASSSGQGYEQY | SEQ ID NO: 484 |
| ASSLTSYEQY | SEQ ID NO: 485 |
| ASSLAGGETQY | SEQ ID NO: 486 |
| ASSFADTQY | SEQ ID NO: 487 |
| ASSFGRNTEAF | SEQ ID NO: 488 |
| ASSFSGSTDTQY | SEQ ID NO: 489 |
| ASSLVQETQY | SEQ ID NO: 490 |
| ASSHTDTQY | SEQ ID NO: 491 |
| ASSFGSTDTQY | SEQ ID NO: 492 |
| ASSPRGNTEAF | SEQ ID NO: 493 |
| ASSSGQGTDTQY | SEQ ID NO: 494 |
| ASSLGRQETQY | SEQ ID NO: 495 |
| ASSGQGNQPQH | SEQ ID NO: 496 |
| ASSLVSTDTQY | SEQ ID NO: 497 |
| ASSSNYEQY | SEQ ID NO: 498 |
| ASSQAYEQY | SEQ ID NO: 499 |
| ASSLGPNQPQH | SEQ ID NO: 500 |
| ASSLQGSYEQY | SEQ ID NO: 501 |
| ASSPGTEAF | SEQ ID NO: 502 |
| ASSSSSYNEQF | SEQ ID NO: 503 |
| ASSASTDTQY | SEQ ID NO: 504 |
| ASSLGPSTDTQY | SEQ ID NO: 505 |
| ASSLDSYGYT | SEQ ID NO: 506 |
| ASSLRGDTQY | SEQ ID NO: 507 |
| ASSFGSSYEQY | SEQ ID NO: 508 |
| ASSHSYEQY | SEQ ID NO: 509 |
| ASSQGSYEQY | SEQ ID NO: 510 |
| ASSLYQETQY | SEQ ID NO: 511 |
| ASSPGTGNTEAF | SEQ ID NO: 512 |
| ASSPQGNQPQH | SEQ ID NO: 513 |
| ASSTYNEQF | SEQ ID NO: 514 |
| ASSSNTDTQY | SEQ ID NO: 515 |
| ASSPRGYEQY | SEQ ID NO: 516 |
| ASSQGGNQPQH | SEQ ID NO: 517 |
| ASSLGDEQF | SEQ ID NO: 518 |
| ASSLRGGTEAF | SEQ ID NO: 519 |
| ASSLGQSNQPQH | SEQ ID NO: 520 |
| ASSLANEQF | SEQ ID NO: 521 |
| ASSLNSYEQY | SEQ ID NO: 522 |
| ASSPGTYEQY | SEQ ID NO: 523 |
| ASSLGTSYEQY | SEQ ID NO: 524 |
| ASSPGGSYEQY | SEQ ID NO: 525 |
| ASSLGPTDTQY | SEQ ID NO: 526 |
| ASSLGQNQPQH | SEQ ID NO: 527 |
| ASSLGGSTEAF | SEQ ID NO: 528 |
| ASSLAGTYEQY | SEQ ID NO: 529 |
| ASSLLYEQY | SEQ ID NO: 530 |
| ASSLGPSYEQY | SEQ ID NO: 531 |
| ASSSGQGNQPQH | SEQ ID NO: 532 |
| ASSPGTSGYNEQF | SEQ ID NO: 533 |
| ASSSGGTEAF | SEQ ID NO: 534 |
| ASSLGNTIY | SEQ ID NO: 535 |
| ASSLGDSNQPQH | SEQ ID NO: 536 |
| ASSLGQGADTQY | SEQ ID NO: 537 |
| ASSLGGPYEQY | SEQ ID NO: 538 |
| ASSLLGTDTQY | SEQ ID NO: 539 |
| ASSLGTGGYEQY | SEQ ID NO: 540 |
| ASSLGGAYEQY | SEQ ID NO: 541 |
| ASSQGNQPQH | SEQ ID NO: 542 |
| ASSLASNQPQH | SEQ ID NO: 543 |
| ASSLGLSYEQY | SEQ ID NO: 544 |
| ASSLDNQPQH | SEQ ID NO: 545 |
| ASSPSYNEQF | SEQ ID NO: 546 |
| ASRDSNQPQH | SEQ ID NO: 547 |
| ASSLSSGNTIY | SEQ ID NO: 548 |

TABLE I-continued

| Sequence | Sequence ID No |
|---|---|
| ASSFGTEAF | SEQ ID NO: 549 |
| ASSLQGLNTEAF | SEQ ID NO: 550 |
| ASSITDTQY | SEQ ID NO: 551 |
| ASSYSNQPQH | SEQ ID NO: 552 |
| ASSPGGDTQY | SEQ ID NO: 553 |
| ASSLDRDQPQH | SEQ ID NO: 554 |
| ASSPGMNTEAF | SEQ ID NO: 555 |
| ASSLPNQPQH | SEQ ID NO: 556 |
| ASSLGPYNEQF | SEQ ID NO: 557 |
| ASSLRQNTEAF | SEQ ID NO: 558 |
| ASSRNTGELF | SEQ ID NO: 559 |
| ASSPSGSTDTQY | SEQ ID NO: 560 |
| ASSLPGTDTQY | SEQ ID NO: 561 |
| ASSLGQGPYEQY | SEQ ID NO: 562 |
| ASSQGNEQF | SEQ ID NO: 563 |
| ASSQGGYEQY | SEQ ID NO: 564 |
| ASSLLGYEQY | SEQ ID NO: 565 |
| ASSLVGNQPQH | SEQ ID NO: 566 |
| ASSLDRAYEQY | SEQ ID NO: 567 |
| ASSPRGTEAF | SEQ ID NO: 568 |
| ASSLVGSTDTQY | SEQ ID NO: 569 |
| ASSLSPNTEAF | SEQ ID NO: 570 |
| ASSPGPNTEAF | SEQ ID NO: 571 |
| ASSYRGNTEAF | SEQ ID NO: 572 |
| ASSLDRDTEAF | SEQ ID NO: 573 |
| ASSSTVNTEAF | SEQ ID NO: 574 |
| ASSSLTDTQY | SEQ ID NO: 575 |
| ASSLLGQPQH | SEQ ID NO: 576 |
| ASSLAGTEAF | SEQ ID NO: 577 |
| ASSSEETQY | SEQ ID NO: 578 |
| ASSLASYEQY | SEQ ID NO: 579 |
| ASSLSTEAF | SEQ ID NO: 580 |
| ASSPGQLNTEAF | SEQ ID NO: 581 |
| ASSRSSYEQY | SEQ ID NO: 582 |
| ASSPGNEQF | SEQ ID NO: 583 |
| ASSLQGMNTEAF | SEQ ID NO: 584 |
| ASSQTDTQY | SEQ ID NO: 585 |
| ASSQGTEAF | SEQ ID NO: 586 |
| ASSFSETQY | SEQ ID NO: 587 |
| ASSPSGSSYNEQF | SEQ ID NO: 588 |
| ASSLDSNYGYT | SEQ ID NO: 589 |
| ASSLGNTGELF | SEQ ID NO: 590 |
| ASSEGYEQY | SEQ ID NO: 591 |
| ASSLTGVNTEAF | SEQ ID NO: 592 |
| ASSQGMNTEAF | SEQ ID NO: 593 |
| ASSYYNEQF | SEQ ID NO: 594 |
| ASSFEETQY | SEQ ID NO: 595 |
| ASSLGEKLF | SEQ ID NO: 596 |
| ASRSTDTQY | SEQ ID NO: 597 |
| ASSPDSNYGYT | SEQ ID NO: 598 |
| ASSLGTGAYEQY | SEQ ID NO: 599 |
| ASSLTGDQPQH | SEQ ID NO: 600 |
| ASSLPSTDTQY | SEQ ID NO: 601 |
| ASSLQGGNQPQH | SEQ ID NO: 602 |
| ASSLDRETQY | SEQ ID NO: 603 |
| ASSRDRAYEQY | SEQ ID NO: 604 |
| ASSLTSGSYEQY | SEQ ID NO: 605 |
| ASSRGNEQF | SEQ ID NO: 606 |
| ASSFGGSYEQY | SEQ ID NO: 607 |
| ASSQDSYEQY | SEQ ID NO: 608 |
| ASSLGGNTIY | SEQ ID NO: 609 |
| ASSLLAGGTDTQY | SEQ ID NO: 610 |
| ASSVGGNTEAF | SEQ ID NO: 611 |
| ASSQNTEAF | SEQ ID NO: 612 |
| ASSLELNTEAF | SEQ ID NO: 613 |
| ASSFTGNTEAF | SEQ ID NO: 614 |
| ASSSGSSYNEQF | SEQ ID NO: 615 |
| ASSSGNTIY | SEQ ID NO: 616 |
| ASSLDMNTEAF | SEQ ID NO: 617 |
| ASSPSGANVLT | SEQ ID NO: 618 |
| ASRGNTEAF | SEQ ID NO: 619 |
| ASSPGLATDTQY | SEQ ID NO: 620 |
| ASSLQGTEAF | SEQ ID NO: 621 |
| ASSFDSNQPQH | SEQ ID NO: 622 |
| ASSAYNEQF | SEQ ID NO: 623 |
| ASSLDYNEQF | SEQ ID NO: 624 |
| ASSLVGGNTEAF | SEQ ID NO: 625 |
| ASSLSGSNQPQH | SEQ ID NO: 626 |

TABLE I-continued

| Sequence | Sequence ID No |
|---|---|
| ASSGTGNQPQH | SEQ ID NO: 627 |
| ASSRQGNQPQH | SEQ ID NO: 628 |
| ASSQGQNTEAF | SEQ ID NO: 629 |
| ASSLSMNTEAF | SEQ ID NO: 630 |
| ASSTSYEQY | SEQ ID NO: 631 |
| ASSLRGQETQY | SEQ ID NO: 632 |
| ASSPGQTYEQY | SEQ ID NO: 633 |
| ASSFSGANVLT | SEQ ID NO: 634 |
| ASSFRGNTEAF | SEQ ID NO: 635 |
| ASSLDRGNTEAF | SEQ ID NO: 636 |
| ASSPDRNQPQH | SEQ ID NO: 637 |
| ASSVYNEQF | SEQ ID NO: 638 |
| ASSPGTGYEQY | SEQ ID NO: 639 |
| ASSPRGTDTQY | SEQ ID NO: 640 |
| ASSLRGSTDTQY | SEQ ID NO: 641 |
| ASSPGVNTEAF | SEQ ID NO: 642 |
| ASSLGGTGELF | SEQ ID NO: 643 |
| ASSLGGGSYEQY | SEQ ID NO: 644 |
| ASSLLGETQY | SEQ ID NO: 645 |
| ASSVSYEQY | SEQ ID NO: 646 |
| ASSSGQGNTEAF | SEQ ID NO: 647 |
| ASSLNYGYT | SEQ ID NO: 648 |
| ASSSGNTEAF | SEQ ID NO: 649 |
| ASSLAGMNTEAF | SEQ ID NO: 650 |
| ASSPGYNEQF | SEQ ID NO: 651 |
| ASSPNYEQY | SEQ ID NO: 652 |
| ASSSTGYEQY | SEQ ID NO: 653 |
| ASSDSNQPQH | SEQ ID NO: 654 |
| ASRRNTEAF | SEQ ID NO: 655 |
| ASSNSYEQY | SEQ ID NO: 656 |
| ASSSGTGSYEQY | SEQ ID NO: 657 |
| ASSLGYTEAF | SEQ ID NO: 658 |
| ASSLWGNTEAF | SEQ ID NO: 659 |
| ASSLGLAGTDTQY | SEQ ID NO: 660 |
| ASSLAGLNTEAF | SEQ ID NO: 661 |
| ASSFSGNTEAF | SEQ ID NO: 662 |
| ASSSSGNTIY | SEQ ID NO: 663 |
| ASSSGGYEQY | SEQ ID NO: 664 |
| ASSRGLNTEAF | SEQ ID NO: 665 |
| ASSLSSGANVLT | SEQ ID NO: 666 |
| ASSLEMNTEAF | SEQ ID NO: 667 |
| ASSLGDEQY | SEQ ID NO: 668 |
| ASSLTGSSYEQY | SEQ ID NO: 669 |
| ASSSGLNTEAF | SEQ ID NO: 670 |
| ASSLGQNTGELF | SEQ ID NO: 671 |
| ASSLANTEAF | SEQ ID NO: 672 |
| ASSPLNTEAF | SEQ ID NO: 673 |
| ASSPGLSTDTQY | SEQ ID NO: 674 |
| ASSPRDTQY | SEQ ID NO: 675 |
| ASSLAGANVLT | SEQ ID NO: 676 |
| ASSGSYEQY | SEQ ID NO: 677 |
| ASSLSGQPQH | SEQ ID NO: 678 |
| ASSLQGNYGYT | SEQ ID NO: 679 |
| ASSFLETQY | SEQ ID NO: 680 |
| ASSLSGQETQY | SEQ ID NO: 681 |
| ASSFDRNTEAF | SEQ ID NO: 682 |
| ASSGTGGNQPQH | SEQ ID NO: 683 |
| ASSLEGTEAF | SEQ ID NO: 684 |
| ASSLENTEAF | SEQ ID NO: 685 |
| ASSLVVNTEAF | SEQ ID NO: 686 |
| ASSLTNTEAF | SEQ ID NO: 687 |
| ASSRDRGTDTQY | SEQ ID NO: 688 |
| ASSFRGTDTQY | SEQ ID NO: 689 |
| ASSLAGQPQH | SEQ ID NO: 690 |
| ASSPGTSTDTQY | SEQ ID NO: 691 |
| ASSLVGQPQH | SEQ ID NO: 692 |
| ASSLDRVNTEAF | SEQ ID NO: 693 |
| ASSNQETQY | SEQ ID NO: 694 |
| ASSLGQGNYGYT | SEQ ID NO: 695 |
| ASSQGVNTEAF | SEQ ID NO: 696 |
| ASSPGQGPYEQY | SEQ ID NO: 697 |
| ASSGGYEQY | SEQ ID NO: 698 |
| ASSLAGAYNEQF | SEQ ID NO: 699 |
| ASSATDTQY | SEQ ID NO: 700 |
| ASSSADTQY | SEQ ID NO: 701 |
| ASSLVPDTQY | SEQ ID NO: 702 |
| ASSLERNTEAF | SEQ ID NO: 703 |
| ASSLDRGNQPQH | SEQ ID NO: 704 |

TABLE I-continued

| Sequence | Sequence ID No |
|---|---|
| ASSLYYEQY | SEQ ID NO: 705 |
| ASSLVGGTDTQY | SEQ ID NO: 706 |
| ASSPRTGNTEAF | SEQ ID NO: 707 |
| ASSQDRNQPQH | SEQ ID NO: 708 |
| ASSSGGTDTQY | SEQ ID NO: 709 |
| ASSLVYEQY | SEQ ID NO: 710 |
| ASSLRTEAF | SEQ ID NO: 711 |
| ASSLLGNQPQH | SEQ ID NO: 712 |
| ASSLVGGTEAF | SEQ ID NO: 713 |
| ASSLGLAGYNEQF | SEQ ID NO: 714 |
| ASSFGVNTEAF | SEQ ID NO: 715 |
| ASSLLGDTQY | SEQ ID NO: 716 |
| ASSQTYEQY | SEQ ID NO: 717 |
| ASSPGTGTYEQY | SEQ ID NO: 718 |
| ASSFGLNTEAF | SEQ ID NO: 719 |
| ASSPGTSYEQY | SEQ ID NO: 720 |
| ASSLLGTEAF | SEQ ID NO: 721 |
| ASSLRGSYEQY | SEQ ID NO: 722 |
| ASSLRGETQY | SEQ ID NO: 723 |
| ASSLGQANTEAF | SEQ ID NO: 724 |
| ASSLDRYEQY | SEQ ID NO: 725 |
| ASSPGPYEQY | SEQ ID NO: 726 |
| ASSSYSNQPQH | SEQ ID NO: 727 |
| ASSLQGYGYT | SEQ ID NO: 728 |
| ASSLGRNYGYT | SEQ ID NO: 729 |
| ASSLETDTQY | SEQ ID NO: 730 |
| ASSLGGGETQY | SEQ ID NO: 731 |
| ASSFRDTQY | SEQ ID NO: 732 |
| ASSLASSYEQY | SEQ ID NO: 733 |
| ASSQADTQY | SEQ ID NO: 734 |
| ASSLGRMNTEAF | SEQ ID NO: 735 |
| ASSLQGNEQF | SEQ ID NO: 736 |
| ASSLGQVNTEAF | SEQ ID NO: 737 |
| ASSLRGSNQPQH | SEQ ID NO: 738 |
| ASSLVGSYEQY | SEQ ID NO: 739 |
| ASSGTDTQY | SEQ ID NO: 740 |
| ASSLGYSNQPQH | SEQ ID NO: 741 |
| ASSLGGVNTEAF | SEQ ID NO: 742 |
| ASSLTYNEQF | SEQ ID NO: 743 |
| ASSLVLNTEAF | SEQ ID NO: 744 |
| ASSPDSYNEQF | SEQ ID NO: 745 |
| ASSLGQGTYEQY | SEQ ID NO: 746 |
| ASSLTRNTEAF | SEQ ID NO: 747 |
| ASSLQGDTEAF | SEQ ID NO: 748 |
| ASSLTGGSYEQY | SEQ ID NO: 749 |
| ASSYSSYEQY | SEQ ID NO: 750 |
| ASSSTTDTQY | SEQ ID NO: 751 |
| ASSLDGNYGYT | SEQ ID NO: 752 |
| ASSLVSNQPQH | SEQ ID NO: 753 |
| ASSPGGNEQF | SEQ ID NO: 754 |
| ASSGGTDTQY | SEQ ID NO: 755 |
| ASSPRGETQY | SEQ ID NO: 756 |
| ASSLVSDTQY | SEQ ID NO: 757 |
| ASSPYSNQPQH | SEQ ID NO: 758 |
| ASSLGRYNEQF | SEQ ID NO: 759 |
| ASSRTGGTEAF | SEQ ID NO: 760 |
| ASSSLNTEAF | SEQ ID NO: 761 |
| ASSPGGSYNEQF | SEQ ID NO: 762 |
| ASSLAGGPYNEQF | SEQ ID NO: 763 |
| ASSLEADTQY | SEQ ID NO: 764 |
| ASSLGGGQPQH | SEQ ID NO: 765 |
| ASSRTANTEAF | SEQ ID NO: 766 |
| ASSLEYEQY | SEQ ID NO: 767 |
| ASSPPSSYEQY | SEQ ID NO: 768 |
| ASSLETQY | SEQ ID NO: 769 |
| ASSLGRTYEQY | SEQ ID NO: 770 |
| ASSEYNEQF | SEQ ID NO: 771 |
| ASSLLNQPQH | SEQ ID NO: 772 |
| ASSYGYEQY | SEQ ID NO: 773 |
| ASSLLAGGYNEQF | SEQ ID NO: 774 |
| ASSQDRDQPQH | SEQ ID NO: 775 |
| ASSLGRDTQY | SEQ ID NO: 776 |
| ASSLSSSYEQY | SEQ ID NO: 777 |
| ASSLGSSTDTQY | SEQ ID NO: 778 |
| ASSPGQAYEQY | SEQ ID NO: 779 |
| ASSYGGNTEAF | SEQ ID NO: 780 |
| ASSLRGDTEAF | SEQ ID NO: 781 |
| ASSLSGSYNEQF | SEQ ID NO: 782 |

TABLE I-continued

| Sequence | Sequence ID No |
|---|---|
| ASSLEGDTQY | SEQ ID NO: 783 |
| ASSLEGETQY | SEQ ID NO: 784 |
| ASSLGQGNSPLH | SEQ ID NO: 785 |
| ASSFSGNTIY | SEQ ID NO: 786 |
| ASSFGNEQF | SEQ ID NO: 787 |
| ASSLRSNQPQH | SEQ ID NO: 788 |
| ASSLDPNTEAF | SEQ ID NO: 789 |
| ASSDTDTQY | SEQ ID NO: 790 |
| ASSLGRGTEAF | SEQ ID NO: 791 |
| ASSLGSSGNTIY | SEQ ID NO: 792 |
| ASSLKDTQY | SEQ ID NO: 793 |
| ASSLAANTEAF | SEQ ID NO: 794 |
| ASSLAGNTIY | SEQ ID NO: 795 |
| ASSPGSYNEQF | SEQ ID NO: 796 |
| ASSSSDTQY | SEQ ID NO: 797 |
| ASSLTSNQPQH | SEQ ID NO: 798 |
| ASSLDSNTEAF | SEQ ID NO: 799 |
| ASSQDRGQPQH | SEQ ID NO: 800 |
| ASSLTGNEQF | SEQ ID NO: 801 |
| ASSPTGNQPQH | SEQ ID NO: 802 |
| ASSLQGANTEAF | SEQ ID NO: 803 |
| ASSLGQGGQPQH | SEQ ID NO: 804 |
| ASSSRYEQY | SEQ ID NO: 805 |
| ASSPRNTEAF | SEQ ID NO: 806 |
| ASSLRLNTEAF | SEQ ID NO: 807 |
| ASSLNRNTEAF | SEQ ID NO: 808 |
| ASSLGRTEAF | SEQ ID NO: 809 |
| ASSFLNTEAF | SEQ ID NO: 810 |
| ASSLAGSGNTIY | SEQ ID NO: 811 |
| ASSYRENTEAF | SEQ ID NO: 812 |
| ASSPPSYEQY | SEQ ID NO: 813 |
| ASSLTGQETQY | SEQ ID NO: 814 |
| ASSLRADTQY | SEQ ID NO: 815 |
| ASSLGGRETQY | SEQ ID NO: 816 |
| ASSLLSTDTQY | SEQ ID NO: 817 |
| ASSLGTGYEQY | SEQ ID NO: 818 |
| ASSPPGETQY | SEQ ID NO: 819 |
| ASSLSTGELF | SEQ ID NO: 820 |
| ASSPGSSYNEQF | SEQ ID NO: 821 |
| ASSLSGTEAF | SEQ ID NO: 822 |
| ASSIGETQY | SEQ ID NO: 823 |
| ASSLTSGSYNEQF | SEQ ID NO: 824 |
| ASSLSENTEAF | SEQ ID NO: 825 |
| ASSSNYGYT | SEQ ID NO: 826 |
| ASSQQGNTEAF | SEQ ID NO: 827 |
| ASSSDSNQPQH | SEQ ID NO: 828 |
| ASSSSGANVLT | SEQ ID NO: 829 |
| ASSLGLAGDTQY | SEQ ID NO: 830 |
| ASSSGSSYEQY | SEQ ID NO: 831 |
| ASSLGVSYEQY | SEQ ID NO: 832 |
| ASSPGYGYT | SEQ ID NO: 833 |
| ASSPSNQPQH | SEQ ID NO: 834 |
| ASSLGGRTDTQY | SEQ ID NO: 835 |
| ASSRTGGNQPQH | SEQ ID NO: 836 |
| ASSVSTDTQY | SEQ ID NO: 837 |
| ASSLRGLNTEAF | SEQ ID NO: 838 |
| ASSSTGGTEAF | SEQ ID NO: 839 |
| ASSQEETQY | SEQ ID NO: 840 |
| ASSLGGEAF | SEQ ID NO: 841 |
| ASSLNQPQH | SEQ ID NO: 842 |
| ASSRGGTEAF | SEQ ID NO: 843 |
| ASSPGQGNYGYT | SEQ ID NO: 844 |
| ASSLAGNYGYT | SEQ ID NO: 845 |
| ASSPLYEQY | SEQ ID NO: 846 |
| ASSLGTGTDTQY | SEQ ID NO: 847 |
| ASSLGRDQPQH | SEQ ID NO: 848 |
| ASSLDTGELF | SEQ ID NO: 849 |
| ASSLGTSGYNEQF | SEQ ID NO: 850 |
| ASSQSSYEQY | SEQ ID NO: 851 |
| ASSLGGGQETQY | SEQ ID NO: 852 |
| ASSPQGNEQF | SEQ ID NO: 853 |
| ASSLVRNTEAF | SEQ ID NO: 854 |
| ASSPGQMNTEAF | SEQ ID NO: 855 |
| ASSLGGGSYNEQF | SEQ ID NO: 856 |
| ASSLRGGTDTQY | SEQ ID NO: 857 |
| ASSPGAYEQY | SEQ ID NO: 858 |
| ASSPRGDTQY | SEQ ID NO: 859 |
| ASSFGGSNQPQH | SEQ ID NO: 860 |

TABLE I-continued

| Sequence | Sequence ID No |
|---|---|
| ASSLEGQPQH | SEQ ID NO: 861 |
| ASSLGQNNEQF | SEQ ID NO: 862 |
| ASSLASYNEQF | SEQ ID NO: 863 |
| ASSYGGTEAF | SEQ ID NO: 864 |
| ASSPSDTQY | SEQ ID NO: 865 |
| ASSLGQGQETQY | SEQ ID NO: 866 |
| ASSSNTGELF | SEQ ID NO: 867 |
| ASSLVRETQY | SEQ ID NO: 868 |
| ASSSYQETQY | SEQ ID NO: 869 |
| ASSLGGYTEAF | SEQ ID NO: 870 |
| ASSLDSSYNEQF | SEQ ID NO: 871 |
| ASSPPNQPQH | SEQ ID NO: 872 |
| ASSLRNQPQH | SEQ ID NO: 873 |
| ASSFSSNQPQH | SEQ ID NO: 874 |
| ASSLVGSNQPQH | SEQ ID NO: 875 |
| ASSPGTGYGYT | SEQ ID NO: 876 |
| ASSPDRGNQPQH | SEQ ID NO: 877 |
| ASSDYNEQF | SEQ ID NO: 878 |
| ASSQDRGYEQY | SEQ ID NO: 879 |
| ASSPGQSTDTQY | SEQ ID NO: 880 |
| ASSYSGNTEAF | SEQ ID NO: 881 |
| ASSLSNTEAF | SEQ ID NO: 882 |
| ASSLDRGYGYT | SEQ ID NO: 883 |
| ASSPRSTDTQY | SEQ ID NO: 884 |
| ASSLGVNQPQH | SEQ ID NO: 885 |
| ASSPGQETQY | SEQ ID NO: 886 |
| ASSESYEQY | SEQ ID NO: 887 |
| ASSLTQETQY | SEQ ID NO: 888 |
| ASSGQLNTEAF | SEQ ID NO: 889 |
| ASSPPGNTEAF | SEQ ID NO: 890 |
| ASSLLADTQY | SEQ ID NO: 891 |
| ASSPNSYEQY | SEQ ID NO: 892 |
| ASSLGRGTDTQY | SEQ ID NO: 893 |
| ASSLNQETQY | SEQ ID NO: 894 |
| ASSLTGYNEQF | SEQ ID NO: 895 |
| ASSSSGSSYNEQF | SEQ ID NO: 896 |
| ASSLRMNTEAF | SEQ ID NO: 897 |
| ASSLITDTQY | SEQ ID NO: 898 |
| ASSLGVQETQY | SEQ ID NO: 899 |
| ASSLTGTYEQY | SEQ ID NO: 900 |
| ASSLESNQPQH | SEQ ID NO: 901 |
| ASSLVENTEAF | SEQ ID NO: 902 |
| ASSTGNTEAF | SEQ ID NO: 903 |
| ASSLGSTEAF | SEQ ID NO: 904 |
| ASSLGGSQETQY | SEQ ID NO: 905 |
| ASSLAGVNTEAF | SEQ ID NO: 906 |
| ASSSRDTQY | SEQ ID NO: 907 |
| ASSPTENTEAF | SEQ ID NO: 908 |
| ASSRGSYEQY | SEQ ID NO: 909 |
| ASSPGGNQPQH | SEQ ID NO: 910 |
| ASSPADTQY | SEQ ID NO: 911 |
| ASSLAGYGYT | SEQ ID NO: 912 |
| ASSLGVTDTQY | SEQ ID NO: 913 |
| ASSPGGGTEAF | SEQ ID NO: 914 |
| ASSLGVYEQY | SEQ ID NO: 915 |
| ASRENTEAF | SEQ ID NO: 916 |
| ASSLTGGYEQY | SEQ ID NO: 917 |
| ASSLAGEQY | SEQ ID NO: 918 |
| ASSLGLNQPQH | SEQ ID NO: 919 |
| ASSYRETQY | SEQ ID NO: 920 |
| ASSSGQGYGYT | SEQ ID NO: 921 |
| ASSQGGTDTQY | SEQ ID NO: 922 |
| ASSLTSGSTDTQY | SEQ ID NO: 923 |
| ASSLYTEAF | SEQ ID NO: 924 |
| ASSPTGSYEQY | SEQ ID NO: 925 |
| ASSRTYEQY | SEQ ID NO: 926 |
| ASSLAGDQPQH | SEQ ID NO: 927 |
| ASSLQMNTEAF | SEQ ID NO: 928 |
| ASSPPGSYEQY | SEQ ID NO: 929 |
| ASSRTGYEQY | SEQ ID NO: 930 |
| ASSLLSYEQY | SEQ ID NO: 931 |
| ASSLGRDTEAF | SEQ ID NO: 932 |
| ASSQGQGYEQY | SEQ ID NO: 933 |
| ASSLRRNTEAF | SEQ ID NO: 934 |
| ASSLDRSTDTQY | SEQ ID NO: 935 |
| ASSLNEQF | SEQ ID NO: 936 |
| ASSLGGANTEAF | SEQ ID NO: 937 |
| ASSLDSQETQY | SEQ ID NO: 938 |

TABLE I-continued

| Sequence | Sequence ID No |
|---|---|
| ASSPDRGYGYT | SEQ ID NO: 939 |
| ASSLGANYGYT | SEQ ID NO: 940 |
| ASSLGSGANVLT | SEQ ID NO: 941 |
| ASSLGGGNEQF | SEQ ID NO: 942 |
| ASSGETQY | SEQ ID NO: 943 |
| ASSYGNTEAF | SEQ ID NO: 944 |
| ASSPTSTDTQY | SEQ ID NO: 945 |
| ASSFNTEAF | SEQ ID NO: 946 |
| ASSLGQGSYNEQF | SEQ ID NO: 947 |
| ASTSTDTQY | SEQ ID NO: 948 |
| ASSLGLAYEQY | SEQ ID NO: 949 |
| ASSPSGYEQY | SEQ ID NO: 950 |
| ASSLRGQPQH | SEQ ID NO: 951 |
| ASSLDRSYEQY | SEQ ID NO: 952 |
| ASSLDRTDTQY | SEQ ID NO: 953 |
| ASSSGSYNEQF | SEQ ID NO: 954 |
| ASSLSGELF | SEQ ID NO: 955 |
| ASSSQGNQPQH | SEQ ID NO: 956 |
| ASSLGTGGTEAF | SEQ ID NO: 957 |
| ASSLQGDQPQH | SEQ ID NO: 958 |
| ASSGDSNQPQH | SEQ ID NO: 959 |
| ASSPGGQETQY | SEQ ID NO: 960 |
| ASSGQETQY | SEQ ID NO: 961 |
| ASSLFTDTQY | SEQ ID NO: 962 |
| ASSLGAEAF | SEQ ID NO: 963 |
| ASSFKETQY | SEQ ID NO: 964 |
| ASSGQGTDTQY | SEQ ID NO: 965 |
| ASSRDTEAF | SEQ ID NO: 966 |
| ASSPGTDYGYT | SEQ ID NO: 967 |
| ASSSGQQETQY | SEQ ID NO: 968 |
| ASSRTGSYEQY | SEQ ID NO: 969 |
| ASSLGGNTGELF | SEQ ID NO: 970 |
| ASSIYNEQF | SEQ ID NO: 971 |
| ASSLGAYNEQF | SEQ ID NO: 972 |
| ASSLGLYEQY | SEQ ID NO: 973 |
| ASSLGRGNTEAF | SEQ ID NO: 974 |
| ASSPDRDQPQH | SEQ ID NO: 975 |
| ASSFRGTEAF | SEQ ID NO: 976 |
| ASSGQGYEQY | SEQ ID NO: 977 |
| ASSRGGNTEAF | SEQ ID NO: 978 |
| ASRGQGNQPQH | SEQ ID NO: 979 |
| ASSLGPEAF | SEQ ID NO: 980 |
| ASSLEGSNQPQH | SEQ ID NO: 981 |
| ASSPTGGTEAF | SEQ ID NO: 982 |
| ASSFRNTEAF | SEQ ID NO: 983 |
| ASSQDRGTEAF | SEQ ID NO: 984 |
| ASSLGRLNTEAF | SEQ ID NO: 985 |
| ASSSPSTDTQY | SEQ ID NO: 986 |
| ASSRQENTEAF | SEQ ID NO: 987 |
| ASSREETQY | SEQ ID NO: 988 |
| ASSLKGNTEAF | SEQ ID NO: 989 |
| ASSPSQETQY | SEQ ID NO: 990 |
| ASSPDYEQY | SEQ ID NO: 991 |
| ASSLGLTDTQY | SEQ ID NO: 992 |
| ASSRTSGTDTQY | SEQ ID NO: 993 |
| ASSRGGTDTQY | SEQ ID NO: 994 |
| ASSPNNEQF | SEQ ID NO: 995 |
| ASSRDRSYEQY | SEQ ID NO: 996 |
| ASSPGQGTYEQY | SEQ ID NO: 997 |
| ASSLGLAGGNEQF | SEQ ID NO: 998 |
| ASSGSSYEQY | SEQ ID NO: 999 |
| ASSSQGGTEAF | SEQ ID NO: 1000 |
| ASSLGLAADTQY | SEQ ID NO: 1001 |
| ASSSDTDTQY | SEQ ID NO: 1002 |
| ASSLTGDTQY | SEQ ID NO: 1003 |
| ASSFGGYEQY | SEQ ID NO: 1004 |
| ASSSGNEQF | SEQ ID NO: 1005 |
| ASSLSGYGYT | SEQ ID NO: 1006 |
| ASSLTGETQY | SEQ ID NO: 1007 |
| ASSLPGNTEAF | SEQ ID NO: 1008 |
| ASSPGLSYEQY | SEQ ID NO: 1009 |
| ASSSFYEQY | SEQ ID NO: 1010 |
| ASSLSGGNQPQH | SEQ ID NO: 1011 |
| ASSPGLAGTDTQY | SEQ ID NO: 1012 |
| ASSGSSYNEQF | SEQ ID NO: 1013 |
| ASSSGANVLT | SEQ ID NO: 1014 |
| ASSLSANTEAF | SEQ ID NO: 1015 |
| ASSLGSEQY | SEQ ID NO: 1016 |

TABLE I-continued

| Sequence | Sequence ID No |
|---|---|
| ASSLGRNEQF | SEQ ID NO: 1017 |
| ASSSGTGAYEQY | SEQ ID NO: 1018 |
| ASSFNTGELF | SEQ ID NO: 1019 |
| ASSLTPNTEAF | SEQ ID NO: 1020 |
| ASSLSGGNTEAF | SEQ ID NO: 1021 |
| ASSPGNQPQH | SEQ ID NO: 1022 |
| ASSLGNSPLH | SEQ ID NO: 1023 |
| ASSLRQGNQPQH | SEQ ID NO: 1024 |
| ASSPGTGPYEQY | SEQ ID NO: 1025 |
| ASSLGRAYEQY | SEQ ID NO: 1026 |
| ASSSGTEAF | SEQ ID NO: 1027 |
| ASSLGGSGANVLT | SEQ ID NO: 1028 |
| ASSLTGTEAF | SEQ ID NO: 1029 |
| ASSSNQPQH | SEQ ID NO: 1030 |
| ASSFSGTDTQY | SEQ ID NO: 1031 |
| ASSPGTSGYEQY | SEQ ID NO: 1032 |
| ASSLDGTDTQY | SEQ ID NO: 1033 |
| ASSPTSYEQY | SEQ ID NO: 1034 |
| ASSLEGNEQF | SEQ ID NO: 1035 |
| ASSLQGGNTEAF | SEQ ID NO: 1036 |
| ASSRQGTDTQY | SEQ ID NO: 1037 |
| ASSSGYNEQF | SEQ ID NO: 1038 |
| ASSLDRYNEQF | SEQ ID NO: 1039 |
| ASSPGQGYNEQF | SEQ ID NO: 1040 |
| ASSLGQTNTEAF | SEQ ID NO: 1041 |
| ASSPGLYNEQF | SEQ ID NO: 1042 |
| ASSLQLNTEAF | SEQ ID NO: 1043 |
| ASSPRGNEQF | SEQ ID NO: 1044 |
| ASSPRDSSYEQY | SEQ ID NO: 1045 |
| ASSSGYGYT | SEQ ID NO: 1046 |
| ASSLTGSGNTIY | SEQ ID NO: 1047 |
| ASSFGGSSYEQY | SEQ ID NO: 1048 |
| ASSLLAGTDTQY | SEQ ID NO: 1049 |
| ASSLGGPDTQY | SEQ ID NO: 1050 |
| ASSLGLGTDTQY | SEQ ID NO: 1051 |
| ASSPQGGTEAF | SEQ ID NO: 1052 |
| ASSLQGSTDTQY | SEQ ID NO: 1053 |
| ASSLAGATDTQY | SEQ ID NO: 1054 |
| ASSLGRGYEQY | SEQ ID NO: 1055 |
| ASSLGLAGGTDTQY | SEQ ID NO: 1056 |
| ASSLEANTEAF | SEQ ID NO: 1057 |
| ASSLQGSGNTIY | SEQ ID NO: 1058 |
| ASSDQETQY | SEQ ID NO: 1059 |
| ASSFGGGTEAF | SEQ ID NO: 1060 |
| ASSPGPSYEQY | SEQ ID NO: 1061 |
| ASRGQGNTEAF | SEQ ID NO: 1062 |
| ASSLGTTDTQY | SEQ ID NO: 1063 |
| ASSLGDYGYT | SEQ ID NO: 1064 |
| ASSLRGSGNTIY | SEQ ID NO: 1065 |
| ASSFGSYEQY | SEQ ID NO: 1066 |
| ASSLGQGYNEQF | SEQ ID NO: 1067 |
| ASSPQGSNQPQH | SEQ ID NO: 1068 |
| ASSRTGNQPQH | SEQ ID NO: 1069 |
| ASSLGQGGYEQY | SEQ ID NO: 1070 |
| ASSPTGSNQPQH | SEQ ID NO: 1071 |
| ASSLGRYEQY | SEQ ID NO: 1072 |
| ASSSGQGAYEQY | SEQ ID NO: 1073 |
| ASSRQGGTEAF | SEQ ID NO: 1074 |
| ASSLGDYEQY | SEQ ID NO: 1075 |
| ASSPDSSYEQY | SEQ ID NO: 1076 |
| ASSYRGTEAF | SEQ ID NO: 1077 |
| ASSLGDSYEQY | SEQ ID NO: 1078 |
| ASSRTSGSYEQY | SEQ ID NO: 1079 |
| ASSLRGEQY | SEQ ID NO: 1080 |
| ASSRGGNQPQH | SEQ ID NO: 1081 |
| ASSLTGDYGYT | SEQ ID NO: 1082 |
| ASSYSGYEQY | SEQ ID NO: 1083 |
| ASSQGGEQY | SEQ ID NO: 1084 |
| ASSLAGDTEAF | SEQ ID NO: 1085 |
| ASSYSGETQY | SEQ ID NO: 1086 |
| ASSPSETQY | SEQ ID NO: 1087 |
| ASSSGQSYEQY | SEQ ID NO: 1088 |
| ASSYGQNTEAF | SEQ ID NO: 1089 |
| ASSFGQGYEQY | SEQ ID NO: 1090 |
| ASSRQGSNQPQH | SEQ ID NO: 1091 |
| ASSPGGSNQPQH | SEQ ID NO: 1092 |
| ASSLGTGTYEQY | SEQ ID NO: 1093 |
| ASSFLDTQY | SEQ ID NO: 1094 |

TABLE I-continued

| Sequence | Sequence ID No |
|---|---|
| ASSLRSSYEQY | SEQ ID NO: 1095 |
| ASSFSGSSYNEQF | SEQ ID NO: 1096 |
| ASSPGGGTDTQY | SEQ ID NO: 1097 |
| ASRQGNQPQH | SEQ ID NO: 1098 |
| ASSLTGAYEQY | SEQ ID NO: 1099 |
| ASSFPNQPQH | SEQ ID NO: 1100 |
| ASSLDRGSYEQY | SEQ ID NO: 1101 |
| ASSSTGGNQPQH | SEQ ID NO: 1102 |
| ASSLGGEETQY | SEQ ID NO: 1103 |
| ASSLVGQETQY | SEQ ID NO: 1104 |
| ASSRDREETQY | SEQ ID NO: 1105 |
| ASSYRNTEAF | SEQ ID NO: 1106 |
| ASSLGATDTQY | SEQ ID NO: 1107 |
| ASSLTSSYEQY | SEQ ID NO: 1108 |
| ASSLDRGQPQH | SEQ ID NO: 1109 |
| ASSLDRQETQY | SEQ ID NO: 1110 |
| ASSLSPDTQY | SEQ ID NO: 1111 |
| ASSLSGYNEQF | SEQ ID NO: 1112 |
| ASSLGQETQY | SEQ ID NO: 1113 |
| ASSQTGNTEAF | SEQ ID NO: 1114 |
| ASSRGNQPQH | SEQ ID NO: 1115 |
| ASSPDGNYGYT | SEQ ID NO: 1116 |
| ASSGGTEAF | SEQ ID NO: 1117 |
| ASSLAGGSTDTQY | SEQ ID NO: 1118 |
| ASSLLGGTEAF | SEQ ID NO: 1119 |
| ASSQGYGYT | SEQ ID NO: 1120 |
| ASSSGTANTEAF | SEQ ID NO: 1121 |
| ASSGTVNTEAF | SEQ ID NO: 1122 |
| ASSLTGGYGYT | SEQ ID NO: 1123 |
| ASSQNTGELF | SEQ ID NO: 1124 |
| ASSFGENTEAF | SEQ ID NO: 1125 |
| ASSLAASTDTQY | SEQ ID NO: 1126 |
| ASSSPNQPQH | SEQ ID NO: 1127 |
| ASSQGPYEQY | SEQ ID NO: 1128 |
| ASSLARTDTQY | SEQ ID NO: 1129 |
| ASSGDSYEQY | SEQ ID NO: 1130 |
| ASSLDSSNQPQH | SEQ ID NO: 1131 |
| ASSFSNEQF | SEQ ID NO: 1132 |
| ASSLGSYGYT | SEQ ID NO: 1133 |
| ASSLSGGYEQY | SEQ ID NO: 1134 |
| ASSLGGRTEAF | SEQ ID NO: 1135 |
| ASRGTDTQY | SEQ ID NO: 1136 |
| ASSLDRDYGYT | SEQ ID NO: 1137 |
| ASSRDRNQPQH | SEQ ID NO: 1138 |
| ASSLAYNEQF | SEQ ID NO: 1139 |
| ASSLTGANTEAF | SEQ ID NO: 1140 |
| ASSRDTDTQY | SEQ ID NO: 1141 |
| ASSLQGYTEAF | SEQ ID NO: 1142 |
| ASRVNTEAF | SEQ ID NO: 1143 |
| ASSLAGGDTQY | SEQ ID NO: 1144 |
| ASSQGGNEQF | SEQ ID NO: 1145 |
| ASSPQGNYGYT | SEQ ID NO: 1146 |
| ASSPGPYNEQF | SEQ ID NO: 1147 |
| ASSLSGNYGYT | SEQ ID NO: 1148 |
| ASSFGMNTEAF | SEQ ID NO: 1149 |
| ASRTGGTEAF | SEQ ID NO: 1150 |
| ASSRQGSYEQY | SEQ ID NO: 1151 |
| ASSSGTGGYEQY | SEQ ID NO: 1152 |
| ASSEQETQY | SEQ ID NO: 1153 |
| ASSHQETQY | SEQ ID NO: 1154 |
| ASSRADTQY | SEQ ID NO: 1155 |
| ASSYSSGANVLT | SEQ ID NO: 1156 |
| ASSPDRDYGYT | SEQ ID NO: 1157 |
| ASSSGQNYGYT | SEQ ID NO: 1158 |
| ASSPGLAGYNEQF | SEQ ID NO: 1159 |
| ASSSGTSGYNEQF | SEQ ID NO: 1160 |
| ASSLLQETQY | SEQ ID NO: 1161 |
| ASSQGNYGYT | SEQ ID NO: 1162 |
| ASSPQGTEAF | SEQ ID NO: 1163 |
| ASSGQMNTEAF | SEQ ID NO: 1164 |
| ASSLSQNTEAF | SEQ ID NO: 1165 |
| ASSLGLDTQY | SEQ ID NO: 1166 |
| ASSSYTEAF | SEQ ID NO: 1167 |
| ASSLANQPQH | SEQ ID NO: 1168 |
| ASSPSGNTIY | SEQ ID NO: 1169 |
| ASSLGQGGNQPQH | SEQ ID NO: 1170 |
| ASSRQNTEAF | SEQ ID NO: 1171 |
| ASSLTANYGYT | SEQ ID NO: 1172 |

TABLE I-continued

| Sequence | Sequence ID No |
|---|---|
| ASSLTGNTIY | SEQ ID NO: 1173 |
| ASSLAGGTYEQY | SEQ ID NO: 1174 |
| ASSTGGTEAF | SEQ ID NO: 1175 |
| ASSLQGSTEAF | SEQ ID NO: 1176 |
| ASSPNSNQPQH | SEQ ID NO: 1177 |
| ASSQGADTQY | SEQ ID NO: 1178 |
| ASRTGNTEAF | SEQ ID NO: 1179 |
| ASSLGVTEAF | SEQ ID NO: 1180 |
| ASSQNYEQY | SEQ ID NO: 1181 |
| ASSLVYNEQF | SEQ ID NO: 1182 |
| ASSSTSTDTQY | SEQ ID NO: 1183 |
| ASSPSSTDTQY | SEQ ID NO: 1184 |
| ASSLGEETQY | SEQ ID NO: 1185 |
| ASSLDREETQY | SEQ ID NO: 1186 |
| ASSLGGRNTEAF | SEQ ID NO: 1187 |
| ASSLPTDTQY | SEQ ID NO: 1188 |
| ASSSSGSTDTQY | SEQ ID NO: 1189 |
| ASSVNTEAF | SEQ ID NO: 1190 |
| ASSLEGGNQPQH | SEQ ID NO: 1191 |
| ASSLGTGGNQPQH | SEQ ID NO: 1192 |
| ASSLDGYGYT | SEQ ID NO: 1193 |
| ASSRMNTEAF | SEQ ID NO: 1194 |
| ASSPTGLNTEAF | SEQ ID NO: 1195 |
| ASSPGQGGTEAF | SEQ ID NO: 1196 |
| ASSVQGNTEAF | SEQ ID NO: 1197 |
| ASSLTGYGYT | SEQ ID NO: 1198 |
| ASSLAGRTDTQY | SEQ ID NO: 1199 |
| ASSLGQNYEQY | SEQ ID NO: 1200 |
| ASSSFTDTQY | SEQ ID NO: 1201 |
| ASSLSRETQY | SEQ ID NO: 1202 |
| ASSNYNEQF | SEQ ID NO: 1203 |
| ASSLAGGADTQY | SEQ ID NO: 1204 |
| ASSSGTYEQY | SEQ ID NO: 1205 |
| ASSSGPYEQY | SEQ ID NO: 1206 |
| ASSLGTGYGYT | SEQ ID NO: 1207 |
| ASSLRGADTQY | SEQ ID NO: 1208 |
| ASSPGLAYEQY | SEQ ID NO: 1209 |
| ASSGTSGSTDTQY | SEQ ID NO: 1210 |
| ASSLGLAGNEQF | SEQ ID NO: 1211 |
| ASSQVGETQY | SEQ ID NO: 1212 |
| ASSPRQGNTEAF | SEQ ID NO: 1213 |
| ASSQGYNEQF | SEQ ID NO: 1214 |
| ASSLSPYEQY | SEQ ID NO: 1215 |
| ASSRNNEQF | SEQ ID NO: 1216 |
| ASSLGLAGYEQY | SEQ ID NO: 1217 |
| ASSLGTDYGYT | SEQ ID NO: 1218 |
| ASSLAPNTEAF | SEQ ID NO: 1219 |
| ASSLSGGSYEQY | SEQ ID NO: 1220 |
| ASSLGASYEQY | SEQ ID NO: 1221 |
| ASSRETQY | SEQ ID NO: 1222 |
| ASSPGGSTDTQY | SEQ ID NO: 1223 |
| ASSSDYEQY | SEQ ID NO: 1224 |
| ASSPGGEQY | SEQ ID NO: 1225 |
| ASRGSTDTQY | SEQ ID NO: 1226 |
| ASSPGSQETQY | SEQ ID NO: 1227 |
| ASSLVGGNQPQH | SEQ ID NO: 1228 |
| ASSGNTEAF | SEQ ID NO: 1229 |
| ASRGSNQPQH | SEQ ID NO: 1230 |
| ASSPSGTDTQY | SEQ ID NO: 1231 |
| ASSRGSNQPQH | SEQ ID NO: 1232 |
| ASTLNTEAF | SEQ ID NO: 1233 |
| ASSLTGSSYNEQF | SEQ ID NO: 1234 |
| ASSPLGETQY | SEQ ID NO: 1235 |
| ASSSGGNTEAF | SEQ ID NO: 1236 |
| ASSLRGMNTEAF | SEQ ID NO: 1237 |
| ASSLRQGNTEAF | SEQ ID NO: 1238 |
| ASSLDTNTEAF | SEQ ID NO: 1239 |
| ASSRGSTDTQY | SEQ ID NO: 1240 |
| ASSWDRNTEAF | SEQ ID NO: 1241 |
| ASSRGQNTEAF | SEQ ID NO: 1242 |
| ASSSYEQY | SEQ ID NO: 1243 |
| ASSPTSGSYNEQF | SEQ ID NO: 1244 |
| ASSSGGNQPQH | SEQ ID NO: 1245 |
| ASRRTDTQY | SEQ ID NO: 1246 |
| ASSWTGNTEAF | SEQ ID NO: 1247 |
| ASSPDSYGYT | SEQ ID NO: 1248 |
| ASSGGNQPQH | SEQ ID NO: 1249 |
| ASSLEQNTEAF | SEQ ID NO: 1250 |

TABLE I-continued

| Sequence | Sequence ID No |
|---|---|
| ASSLAGPYEQY | SEQ ID NO: 1251 |
| ASSLGLNNEQF | SEQ ID NO: 1252 |
| ASSLVNQPQH | SEQ ID NO: 1253 |
| ASSVGETQY | SEQ ID NO: 1254 |
| ASSLDRLNTEAF | SEQ ID NO: 1255 |
| ASSQGGETQY | SEQ ID NO: 1256 |
| ASSRDRGETQY | SEQ ID NO: 1257 |
| ASSFGGQETQY | SEQ ID NO: 1258 |
| ASRSSYEQY | SEQ ID NO: 1259 |
| ASSLPQETQY | SEQ ID NO: 1260 |
| ASSPGPNQPQH | SEQ ID NO: 1261 |
| ASSFSGGTDTQY | SEQ ID NO: 1262 |
| ASRGYNEQF | SEQ ID NO: 1263 |
| ASSQDLGQPQH | SEQ ID NO: 1264 |
| ASSPGTYNEQF | SEQ ID NO: 1265 |
| ASSLGQPNTEAF | SEQ ID NO: 1266 |
| ASSLDETQY | SEQ ID NO: 1267 |
| ASSLDGSYEQY | SEQ ID NO: 1268 |
| ASSPRGGTEAF | SEQ ID NO: 1269 |
| ASSLSGSGNTIY | SEQ ID NO: 1270 |
| ASSLGSEAF | SEQ ID NO: 1271 |
| ASSLEGNYGYT | SEQ ID NO: 1272 |
| ASSLAGELF | SEQ ID NO: 1273 |
| ASSRTGSNQPQH | SEQ ID NO: 1274 |
| ASSLQGADTQY | SEQ ID NO: 1275 |
| ASSLVDEQF | SEQ ID NO: 1276 |
| ASSSRGNTEAF | SEQ ID NO: 1277 |
| ASSFGGNEQF | SEQ ID NO: 1278 |
| ASSPRADTQY | SEQ ID NO: 1279 |
| ASSISTDTQY | SEQ ID NO: 1280 |
| ASSLVQNTEAF | SEQ ID NO: 1281 |
| ASSQGPNTEAF | SEQ ID NO: 1282 |
| ASSPGGYGYT | SEQ ID NO: 1283 |
| ASSLGREETQY | SEQ ID NO: 1284 |
| ASSSGSNQPQH | SEQ ID NO: 1285 |
| ASSWTVNTEAF | SEQ ID NO: 1286 |
| ASSLRGGNTEAF | SEQ ID NO: 1287 |
| ASSLRDTEAF | SEQ ID NO: 1288 |
| ASSLRYNEQF | SEQ ID NO: 1289 |
| ASSLGLAEETQY | SEQ ID NO: 1290 |
| ASSGAYEQY | SEQ ID NO: 1291 |
| ASSRLNTEAF | SEQ ID NO: 1292 |
| ASSLGDNEQF | SEQ ID NO: 1293 |
| ASSRDSNYGYT | SEQ ID NO: 1294 |
| ASSLGTSGTDTQY | SEQ ID NO: 1295 |
| ASSPLNEQF | SEQ ID NO: 1296 |
| ASSRDRDQPQH | SEQ ID NO: 1297 |
| ASSPTANTEAF | SEQ ID NO: 1298 |
| ASSQDLNQPQH | SEQ ID NO: 1299 |
| ASSSRGTDTQY | SEQ ID NO: 1300 |
| ASSLVGSSYEQY | SEQ ID NO: 1301 |
| ASSLGYQETQY | SEQ ID NO: 1302 |
| ASSPSGGTDTQY | SEQ ID NO: 1303 |
| ASSLRDEQF | SEQ ID NO: 1304 |
| ASSLQGQETQY | SEQ ID NO: 1305 |
| ASSPGPQETQY | SEQ ID NO: 1306 |
| ASSYGGNQPQH | SEQ ID NO: 1307 |
| ASSEQGNTEAF | SEQ ID NO: 1308 |
| ASSRSNQPQH | SEQ ID NO: 1309 |
| ASSQGSTDTQY | SEQ ID NO: 1310 |
| ASSYSRNTEAF | SEQ ID NO: 1311 |
| ASSLGGGYT | SEQ ID NO: 1312 |
| ASSQDLNTEAF | SEQ ID NO: 1313 |
| ASSRGQQETQY | SEQ ID NO: 1314 |
| ASSSGTVNTEAF | SEQ ID NO: 1315 |
| ASSLEGSTDTQY | SEQ ID NO: 1316 |
| ASSLQGAYEQY | SEQ ID NO: 1317 |
| ASSRDYEQY | SEQ ID NO: 1318 |
| ASRLAGGTDTQY | SEQ ID NO: 1319 |
| ASSLGTGQETQY | SEQ ID NO: 1320 |
| ASSLVMNTEAF | SEQ ID NO: 1321 |
| ASSLGLADTQY | SEQ ID NO: 1322 |
| ASSPLAGGYNEQF | SEQ ID NO: 1323 |
| ASSLRGYGYT | SEQ ID NO: 1324 |
| ASSLGVYNEQF | SEQ ID NO: 1325 |
| ASSWGNTEAF | SEQ ID NO: 1326 |
| ASSRDSYGYT | SEQ ID NO: 1327 |
| ASSLPNTEAF | SEQ ID NO: 1328 |

TABLE I-continued

| Sequence | Sequence ID No |
|---|---|
| ASSSGQLNTEAF | SEQ ID NO: 1329 |
| ASSRGMNTEAF | SEQ ID NO: 1330 |
| ASSWGTDTQY | SEQ ID NO: 1331 |
| ASSLGGGYGYT | SEQ ID NO: 1332 |
| ASSFRTDTQY | SEQ ID NO: 1333 |
| ASSPLGDTQY | SEQ ID NO: 1334 |
| ASSLGGGYNEQF | SEQ ID NO: 1335 |
| ASSLDRGETQY | SEQ ID NO: 1336 |
| ASSLDGSTDTQY | SEQ ID NO: 1337 |
| ASSYGRNTEAF | SEQ ID NO: 1338 |
| ASSLDSSGNTIY | SEQ ID NO: 1339 |
| ASSLTSYNEQF | SEQ ID NO: 1340 |
| ASSRVNTEAF | SEQ ID NO: 1341 |
| ASSLRGGNQPQH | SEQ ID NO: 1342 |
| ASSRTSTDTQY | SEQ ID NO: 1343 |
| ASSRTVQETQY | SEQ ID NO: 1344 |
| ASSLDRGSYNEQF | SEQ ID NO: 1345 |
| ASSLVGEQY | SEQ ID NO: 1346 |
| ASSSSGGTDTQY | SEQ ID NO: 1347 |
| ASSWDSSYEQY | SEQ ID NO: 1348 |
| ASSPGQGADTQY | SEQ ID NO: 1349 |
| ASSSGADTQY | SEQ ID NO: 1350 |
| ASSEGNQPQH | SEQ ID NO: 1351 |
| ASSRTGGTDTQY | SEQ ID NO: 1352 |
| ASSLGTQETQY | SEQ ID NO: 1353 |
| ASSLYTGELF | SEQ ID NO: 1354 |
| ASSLSGEQY | SEQ ID NO: 1355 |
| ASSLAPDTQY | SEQ ID NO: 1356 |
| ASSSTSYEQY | SEQ ID NO: 1357 |
| ASSPTGDYGYT | SEQ ID NO: 1358 |
| ASSLGQGNEQF | SEQ ID NO: 1359 |
| ASSLGQGSNQPQH | SEQ ID NO: 1360 |
| ASSLVGEQF | SEQ ID NO: 1361 |
| ASSPTGMNTEAF | SEQ ID NO: 1362 |
| ASSRQGGNQPQH | SEQ ID NO: 1363 |
| ASSLGNYGYT | SEQ ID NO: 1364 |
| ASSPDSTDTQY | SEQ ID NO: 1365 |
| ASSLRDSNQPQH | SEQ ID NO: 1366 |
| ASSFGGGTDTQY | SEQ ID NO: 1367 |
| ASSYLETQY | SEQ ID NO: 1368 |
| ASSSGTSTDTQY | SEQ ID NO: 1369 |
| ASSRTSGSTDTQY | SEQ ID NO: 1370 |
| ASSPGQSNQPQH | SEQ ID NO: 1371 |
| ASSFGTGSYEQY | SEQ ID NO: 1372 |
| ASSLRGSYNEQF | SEQ ID NO: 1373 |
| ASSDSTDTQY | SEQ ID NO: 1374 |
| ASSPDYNEQF | SEQ ID NO: 1375 |
| ASSLGTGPYEQY | SEQ ID NO: 1376 |
| ASSPGTAQETQY | SEQ ID NO: 1377 |
| ASSLVPYEQY | SEQ ID NO: 1378 |
| ASSPYTGELF | SEQ ID NO: 1379 |
| ASSPSMNTEAF | SEQ ID NO: 1380 |
| ASSLGGAEAF | SEQ ID NO: 1381 |
| ASSYRGNQPQH | SEQ ID NO: 1382 |
| ASSGGSTDTQY | SEQ ID NO: 1383 |
| ASSLGYEQF | SEQ ID NO: 1384 |
| ASSFSYNEQF | SEQ ID NO: 1385 |
| ASSLLVNTEAF | SEQ ID NO: 1386 |
| ASSGTGNTEAF | SEQ ID NO: 1387 |
| ASSESTDTQY | SEQ ID NO: 1388 |
| ASSLSGGSYNEQF | SEQ ID NO: 1389 |
| ASSLRTGNTEAF | SEQ ID NO: 1390 |
| ASSPQGTDTQY | SEQ ID NO: 1391 |
| ASSLSNTGELF | SEQ ID NO: 1392 |
| ASSYSGANVLT | SEQ ID NO: 1393 |
| ASSLAMNTEAF | SEQ ID NO: 1394 |
| ASSLDSLNTEAF | SEQ ID NO: 1395 |
| ASSPGTAYGYT | SEQ ID NO: 1396 |
| ASSPFTDTQY | SEQ ID NO: 1397 |
| ASSPTGTDTQY | SEQ ID NO: 1398 |
| ASSYGDTQY | SEQ ID NO: 1399 |
| ASSYGSNQPQH | SEQ ID NO: 1400 |
| ASSLPSYEQY | SEQ ID NO: 1401 |
| ASSLASDTQY | SEQ ID NO: 1402 |
| ASSPRVNTEAF | SEQ ID NO: 1403 |
| ASSLGAGNTEAF | SEQ ID NO: 1404 |
| ASSQGGGTEAF | SEQ ID NO: 1405 |
| ASSLAQNTEAF | SEQ ID NO: 1406 |

TABLE I-continued

| Sequence | Sequence ID No |
|---|---|
| ASSSRGYEQY | SEQ ID NO: 1407 |
| ASRQNTEAF | SEQ ID NO: 1408 |
| ASSLGGDYGYT | SEQ ID NO: 1409 |
| ASSWDSNQPQH | SEQ ID NO: 1410 |
| ASSENTEAF | SEQ ID NO: 1411 |
| ASSPRQNTEAF | SEQ ID NO: 1412 |
| ASSPGNTIY | SEQ ID NO: 1413 |
| ASSPQNTEAF | SEQ ID NO: 1414 |
| ASSEETQY | SEQ ID NO: 1415 |
| ASSRGQETQY | SEQ ID NO: 1416 |
| ASSLQRNTEAF | SEQ ID NO: 1417 |
| ASSLDSSTDTQY | SEQ ID NO: 1418 |
| ASSPSNEQF | SEQ ID NO: 1419 |
| ASSSVNTEAF | SEQ ID NO: 1420 |
| ASSSPTDTQY | SEQ ID NO: 1421 |
| ASSPSGDTQY | SEQ ID NO: 1422 |
| ASSSNNEQF | SEQ ID NO: 1423 |
| ASSFSNTEAF | SEQ ID NO: 1424 |
| ASSSKETQY | SEQ ID NO: 1425 |
| ASSPRQGSYEQY | SEQ ID NO: 1426 |
| ASSPGQGNSPLH | SEQ ID NO: 1427 |
| ASSPRENTEAF | SEQ ID NO: 1428 |
| ASSLASSYNEQF | SEQ ID NO: 1429 |
| ASSLTSGYNEQF | SEQ ID NO: 1430 |
| ASSFSSYNEQF | SEQ ID NO: 1431 |
| ASSSGRNTEAF | SEQ ID NO: 1432 |
| ASSLTGSTEAF | SEQ ID NO: 1433 |
| ASSRDSSYNEQF | SEQ ID NO: 1434 |
| ASSAGYEQY | SEQ ID NO: 1435 |
| ASSPGTNTEAF | SEQ ID NO: 1436 |
| ASSLGNEQY | SEQ ID NO: 1437 |
| ASSLDGSSYNEQF | SEQ ID NO: 1438 |
| ASSLDRGQETQY | SEQ ID NO: 1439 |
| ASSPLAGGTDTQY | SEQ ID NO: 1440 |
| ASSSQGNEQF | SEQ ID NO: 1441 |
| ASSLLNTGELF | SEQ ID NO: 1442 |
| ASSLTSGQETQY | SEQ ID NO: 1443 |
| ASSLAGGGTDTQY | SEQ ID NO: 1444 |
| ASSFSSTDTQY | SEQ ID NO: 1445 |
| ASSPGTEETQY | SEQ ID NO: 1446 |
| ASSLTNEQF | SEQ ID NO: 1447 |
| ASSSLNQPQH | SEQ ID NO: 1448 |
| ASSPGTSSYNEQF | SEQ ID NO: 1449 |
| ASSLDRDTQY | SEQ ID NO: 1450 |
| ASSPRGDTEAF | SEQ ID NO: 1451 |
| ASSFRGNQPQH | SEQ ID NO: 1452 |
| ASSFSGYEQY | SEQ ID NO: 1453 |
| ASSLNSYNEQF | SEQ ID NO: 1454 |
| ASSRDRGNQPQH | SEQ ID NO: 1455 |
| ASSLAGEQF | SEQ ID NO: 1456 |
| ASSRTGGYEQY | SEQ ID NO: 1457 |
| ASSPTLNTEAF | SEQ ID NO: 1458 |
| ASSADRNTEAF | SEQ ID NO: 1459 |
| ASSLDGSNQPQH | SEQ ID NO: 1460 |
| ASSPTGDTQY | SEQ ID NO: 1461 |
| ASSFGPNTEAF | SEQ ID NO: 1462 |
| ASGSYEQY | SEQ ID NO: 1463 |
| ASSPSGETQY | SEQ ID NO: 1464 |
| ASSLGGPNTEAF | SEQ ID NO: 1465 |
| ASSQDYEQY | SEQ ID NO: 1466 |
| ASSSLETQY | SEQ ID NO: 1467 |
| ASSQDGNQPQH | SEQ ID NO: 1468 |
| ASSLESTDTQY | SEQ ID NO: 1469 |
| ASSLGTLNTEAF | SEQ ID NO: 1470 |
| ASSLANTGELF | SEQ ID NO: 1471 |
| ASSLGKNTEAF | SEQ ID NO: 1472 |
| ASSQDTDTQY | SEQ ID NO: 1473 |
| ASSPDSQETQY | SEQ ID NO: 1474 |
| ASSLRTGELF | SEQ ID NO: 1475 |
| ASSVGTDTQY | SEQ ID NO: 1476 |
| ASSRTGELF | SEQ ID NO: 1477 |
| ASSSGPNTEAF | SEQ ID NO: 1478 |
| ASSLDRANTEAF | SEQ ID NO: 1479 |
| ASSQRETQY | SEQ ID NO: 1480 |
| ASSLGREQY | SEQ ID NO: 1481 |
| ASSPGTGGTEAF | SEQ ID NO: 1482 |
| ASSRDGNQPQH | SEQ ID NO: 1483 |
| ASSPGGSGNTIY | SEQ ID NO: 1484 |

TABLE I-continued

| Sequence | Sequence ID No |
|---|---|
| ASSYSGSTDTQY | SEQ ID NO: 1485 |
| ASSYGTSTDTQY | SEQ ID NO: 1486 |
| ASSYSGGTEAF | SEQ ID NO: 1487 |
| ASSPSLNTEAF | SEQ ID NO: 1488 |
| ASSLGGDEQF | SEQ ID NO: 1489 |
| ASSLGTNYGYT | SEQ ID NO: 1490 |
| ASRGTGNQPQH | SEQ ID NO: 1491 |
| ASSLTGSYNEQF | SEQ ID NO: 1492 |
| ASSLGGGEQY | SEQ ID NO: 1493 |
| ASSLTMNTEAF | SEQ ID NO: 1494 |
| ASSPGTQETQY | SEQ ID NO: 1495 |
| ASSLAGNTGELF | SEQ ID NO: 1496 |
| ASSRTSGYNEQF | SEQ ID NO: 1497 |
| ASSLSGDTEAF | SEQ ID NO: 1498 |
| ASSFSGSSYEQY | SEQ ID NO: 1499 |
| ASSLRSYEQY | SEQ ID NO: 1500 |
| ASSSGGSYNEQF | SEQ ID NO: 1501 |
| ASSPTYNEQF | SEQ ID NO: 1502 |
| ASSFRENTEAF | SEQ ID NO: 1503 |
| ASSRQGMNTEAF | SEQ ID NO: 1504 |
| ASSLSSSYNEQF | SEQ ID NO: 1505 |
| ASSLGSQPQH | SEQ ID NO: 1506 |
| ASSLGAGELF | SEQ ID NO: 1507 |
| ASSTGYEQY | SEQ ID NO: 1508 |
| ASSPDRGTEAF | SEQ ID NO: 1509 |
| ASSLRGDQPQH | SEQ ID NO: 1510 |
| ASSLDRGGTEAF | SEQ ID NO: 1511 |
| ASSLGSNYGYT | SEQ ID NO: 1512 |
| ASSLLGGNTEAF | SEQ ID NO: 1513 |
| ASSLGSNEQF | SEQ ID NO: 1514 |
| ASSLGVSTDTQY | SEQ ID NO: 1515 |
| ASSQDRGNTEAF | SEQ ID NO: 1516 |
| ASSFGTGELF | SEQ ID NO: 1517 |
| ASSPHTDTQY | SEQ ID NO: 1518 |
| ASSFTYEQY | SEQ ID NO: 1519 |
| ASSVDSNQPQH | SEQ ID NO: 1520 |
| ASSPQGLNTEAF | SEQ ID NO: 1521 |
| ASSLSSDTQY | SEQ ID NO: 1522 |
| ASSGSNQPQH | SEQ ID NO: 1523 |
| ASSLSRGTEAF | SEQ ID NO: 1524 |
| ASRRDSNQPQH | SEQ ID NO: 1525 |
| ASSLTNTGELF | SEQ ID NO: 1526 |
| ASSLGHEQY | SEQ ID NO: 1527 |
| ASSPSGSYEQY | SEQ ID NO: 1528 |
| ASSLGGYSNQPQH | SEQ ID NO: 1529 |
| ASSLGGELF | SEQ ID NO: 1530 |
| ASSPDLNTEAF | SEQ ID NO: 1531 |
| ASSDSSGANVLT | SEQ ID NO: 1532 |
| ASSLNYNEQF | SEQ ID NO: 1533 |
| ASRQGNTEAF | SEQ ID NO: 1534 |
| ASSSTGNQPQH | SEQ ID NO: 1535 |
| ASSLVGADTQY | SEQ ID NO: 1536 |
| ASSLGRGNQPQH | SEQ ID NO: 1537 |
| ASSLGTAQETQY | SEQ ID NO: 1538 |
| ASSLEGLNTEAF | SEQ ID NO: 1539 |
| ASSRLAGGTDTQY | SEQ ID NO: 1540 |
| ASSFSVNTEAF | SEQ ID NO: 1541 |
| ASSLGLANEQF | SEQ ID NO: 1542 |
| ASSLDTYEQY | SEQ ID NO: 1543 |
| ASSPSGSYNEQF | SEQ ID NO: 1544 |
| ASSPGTGGNQPQH | SEQ ID NO: 1545 |
| ASSSDSYNEQF | SEQ ID NO: 1546 |
| ASSYSNEQF | SEQ ID NO: 1547 |
| ASSPGTSGTDTQY | SEQ ID NO: 1548 |
| ASSSTENTEAF | SEQ ID NO: 1549 |
| ASSVGDTQY | SEQ ID NO: 1550 |
| ASSPDNEQF | SEQ ID NO: 1551 |
| ASSPSGNTEAF | SEQ ID NO: 1552 |
| ASSRTGDTEAF | SEQ ID NO: 1553 |
| ASSLRGTGELF | SEQ ID NO: 1554 |
| ASSLQGYNEQF | SEQ ID NO: 1555 |
| ASSFGQGNTEAF | SEQ ID NO: 1556 |
| ASSLGTSGYEQY | SEQ ID NO: 1557 |
| ASSLRGSSYNEQF | SEQ ID NO: 1558 |
| ASSLSRTDTQY | SEQ ID NO: 1559 |
| ASSLGSSNQPQH | SEQ ID NO: 1560 |
| ASSNTGELF | SEQ ID NO: 1561 |
| ASSEQGYEQY | SEQ ID NO: 1562 |

TABLE I-continued

| Sequence | Sequence ID No |
|---|---|
| ASSLSRDTQY | SEQ ID NO: 1563 |
| ASSFSGNQPQH | SEQ ID NO: 1564 |
| ASRSYNEQF | SEQ ID NO: 1565 |
| ASSLGLAGSTDTQY | SEQ ID NO: 1566 |
| ASSPGGYNEQF | SEQ ID NO: 1567 |
| ASSLGGSYGYT | SEQ ID NO: 1568 |
| ASSPGQYNEQF | SEQ ID NO: 1569 |
| ASSLRANTEAF | SEQ ID NO: 1570 |
| ASSQDQETQY | SEQ ID NO: 1571 |
| ASSRSSYNEQF | SEQ ID NO: 1572 |
| ASSLPGYEQY | SEQ ID NO: 1573 |
| ASSLRGNYGYT | SEQ ID NO: 1574 |
| ASSFLYEQY | SEQ ID NO: 1575 |
| ASSFLNQPQH | SEQ ID NO: 1576 |
| ASSPGQGQETQY | SEQ ID NO: 1577 |
| ASSPRLNTEAF | SEQ ID NO: 1578 |
| ASSDRGNQPQH | SEQ ID NO: 1579 |
| ASSFGQGNQPQH | SEQ ID NO: 1580 |
| ASSLGAQETQY | SEQ ID NO: 1581 |
| ASSLDGYNEQF | SEQ ID NO: 1582 |
| ASSLAGTYNEQF | SEQ ID NO: 1583 |
| ASSLPGSYEQY | SEQ ID NO: 1584 |
| ASSPQGGNQPQH | SEQ ID NO: 1585 |
| ASSPPGDTQY | SEQ ID NO: 1586 |
| ASSLGQGDQPQH | SEQ ID NO: 1587 |
| ASSLSGGQETQY | SEQ ID NO: 1588 |
| ASSLSRDTEAF | SEQ ID NO: 1589 |
| ASSPDGNTEAF | SEQ ID NO: 1590 |
| ASSLAGPTDTQY | SEQ ID NO: 1591 |
| ASSFGGETQY | SEQ ID NO: 1592 |
| ASSPGQETQY | SEQ ID NO: 1593 |
| ASSFQGTDTQY | SEQ ID NO: 1594 |
| ASSLQANTEAF | SEQ ID NO: 1595 |
| ASSLGQSSYNEQF | SEQ ID NO: 1596 |
| ASSQGLQETQY | SEQ ID NO: 1597 |
| SARQGDTEAF | SEQ ID NO: 1598 |
| ASSPGTGTDTQY | SEQ ID NO: 1599 |
| ASSLINEQF | SEQ ID NO: 1600 |
| ASSLGGAYNEQF | SEQ ID NO: 1601 |
| ASSLYEQY | SEQ ID NO: 1602 |
| ASSSGGETQY | SEQ ID NO: 1603 |
| ASSLAGPYNEQF | SEQ ID NO: 1604 |
| ASSRDNEQF | SEQ ID NO: 1605 |
| ASSLAGANTEAF | SEQ ID NO: 1606 |
| ASSPTGGTDTQY | SEQ ID NO: 1607 |
| ASSLTSSYNEQF | SEQ ID NO: 1608 |
| ASSLGNSNQPQH | SEQ ID NO: 1609 |
| ASSPSGSSYEQY | SEQ ID NO: 1610 |
| ASSSHYEQY | SEQ ID NO: 1611 |
| ASSYSRETQY | SEQ ID NO: 1612 |
| ASSASSYEQY | SEQ ID NO: 1613 |
| ASSPGQGGYEQY | SEQ ID NO: 1614 |
| ASSLDRMNTEAF | SEQ ID NO: 1615 |
| ASSLEGSYEQY | SEQ ID NO: 1616 |
| ASRMNTEAF | SEQ ID NO: 1617 |
| ASSQDSYNEQF | SEQ ID NO: 1618 |
| ASSQGGQPQH | SEQ ID NO: 1619 |
| ASSLDVNTEAF | SEQ ID NO: 1620 |
| ASSLHNEQF | SEQ ID NO: 1621 |
| ASSPTGDTEAF | SEQ ID NO: 1622 |
| ASSRGSYNEQF | SEQ ID NO: 1623 |
| ASSPDQETQY | SEQ ID NO: 1624 |
| ASSPGTGQETQY | SEQ ID NO: 1625 |
| ASSLAGGPNEQF | SEQ ID NO: 1626 |
| ASSPDRGNTEAF | SEQ ID NO: 1627 |
| ASSLVGSSYNEQF | SEQ ID NO: 1628 |
| ASSGTANTEAF | SEQ ID NO: 1629 |
| ASSSGVNTEAF | SEQ ID NO: 1630 |
| ASSPPGQPQH | SEQ ID NO: 1631 |
| ASSSTGNYGYT | SEQ ID NO: 1632 |
| ASSQGGSNQPQH | SEQ ID NO: 1633 |
| ASSLNLNTEAF | SEQ ID NO: 1634 |
| ASSPDRGTDTQY | SEQ ID NO: 1635 |
| ASSSGQGSYEQY | SEQ ID NO: 1636 |
| ASSPGGNYGYT | SEQ ID NO: 1637 |
| ASSLGQPYEQY | SEQ ID NO: 1638 |
| ASSLVSSYEQY | SEQ ID NO: 1639 |
| ASSPQVNTEAF | SEQ ID NO: 1640 |

TABLE I-continued

| Sequence | Sequence ID No |
|---|---|
| ASSPMNTEAF | SEQ ID NO: 1641 |
| ASSLSNYGYT | SEQ ID NO: 1642 |
| ASSSGGYGYT | SEQ ID NO: 1643 |
| ASSPRTGSYEQY | SEQ ID NO: 1644 |
| ASSLGTVQETQY | SEQ ID NO: 1645 |
| ASSPGLAGYEQY | SEQ ID NO: 1646 |
| ASSLAGVTDTQY | SEQ ID NO: 1647 |
| ASSYSDTQY | SEQ ID NO: 1648 |
| ASSYSETQY | SEQ ID NO: 1649 |
| ASSLVANTEAF | SEQ ID NO: 1650 |
| ASSFGADTQY | SEQ ID NO: 1651 |
| ASSLQGVNTEAF | SEQ ID NO: 1652 |
| ASSLLGSNQPQH | SEQ ID NO: 1653 |
| ASSLTGYTEAF | SEQ ID NO: 1654 |
| ASSLEENTEAF | SEQ ID NO: 1655 |
| ASSLAGGQPQH | SEQ ID NO: 1656 |
| ASSRGGSTDTQY | SEQ ID NO: 1657 |
| ASSLTDSNQPQH | SEQ ID NO: 1658 |
| ASSSGTGTYEQY | SEQ ID NO: 1659 |
| ASSLGQGAYNEQF | SEQ ID NO: 1660 |
| ASSLTGNTGELF | SEQ ID NO: 1661 |
| ASSPTSGSYEQY | SEQ ID NO: 1662 |
| ASSLAGRNTEAF | SEQ ID NO: 1663 |
| ASSPRGSYEQY | SEQ ID NO: 1664 |
| ASSLGVNEQF | SEQ ID NO: 1665 |
| ASSETDTQY | SEQ ID NO: 1666 |
| ASSFQGNQPQH | SEQ ID NO: 1667 |
| ASSSGQTYEQY | SEQ ID NO: 1668 |
| ASSFGQGAYEQY | SEQ ID NO: 1669 |
| ASSWGYEQY | SEQ ID NO: 1670 |
| ASSSQGTDTQY | SEQ ID NO: 1671 |
| ASSSPSYEQY | SEQ ID NO: 1672 |
| ASSPDGNQPQH | SEQ ID NO: 1673 |
| ASSLQGGQPQH | SEQ ID NO: 1674 |
| ASSSGLQETQY | SEQ ID NO: 1675 |
| ASSLSGADTQY | SEQ ID NO: 1676 |
| ASSLGQSYGYT | SEQ ID NO: 1677 |
| SARDSNQPQH | SEQ ID NO: 1678 |
| ASSLANYGYT | SEQ ID NO: 1679 |
| ASRTSTDTQY | SEQ ID NO: 1680 |
| ASSFPNTEAF | SEQ ID NO: 1681 |
| ASSPRYEQY | SEQ ID NO: 1682 |
| ASSRYQETQY | SEQ ID NO: 1683 |
| ASSSTYNEQF | SEQ ID NO: 1684 |
| ASSPGNYGYT | SEQ ID NO: 1685 |
| ASSLESYEQY | SEQ ID NO: 1686 |
| ASSLAEETQY | SEQ ID NO: 1687 |
| ASRTSGTDTQY | SEQ ID NO: 1688 |
| ASSQQGYEQY | SEQ ID NO: 1689 |
| ASSYDSNQPQH | SEQ ID NO: 1690 |
| ASSFTSTDTQY | SEQ ID NO: 1691 |
| ASRTGNQPQH | SEQ ID NO: 1692 |
| ASSSPDTQY | SEQ ID NO: 1693 |
| ASSYGSSYEQY | SEQ ID NO: 1694 |
| ASSLNSGNTIY | SEQ ID NO: 1695 |
| ASSFGDTEAF | SEQ ID NO: 1696 |
| ASGSTDTQY | SEQ ID NO: 1697 |
| ASSRTGSTDTQY | SEQ ID NO: 1698 |
| ASSYRVNTEAF | SEQ ID NO: 1699 |
| ASSLGGGGTEAF | SEQ ID NO: 1700 |
| ASSFSLNTEAF | SEQ ID NO: 1701 |
| ASSLDADTQY | SEQ ID NO: 1702 |
| ASSLGRSSYEQY | SEQ ID NO: 1703 |
| ASSLGYTDTQY | SEQ ID NO: 1704 |
| ASSLGPTYEQY | SEQ ID NO: 1705 |
| ASSLGTTYEQY | SEQ ID NO: 1706 |
| ASSRTGQETQY | SEQ ID NO: 1707 |
| ASSLAGTGELF | SEQ ID NO: 1708 |
| ASSQGQGNQPQH | SEQ ID NO: 1709 |
| ASSLVGDTEAF | SEQ ID NO: 1710 |
| ASSRGQGNTEAF | SEQ ID NO: 1711 |
| ASSRTGSSYEQY | SEQ ID NO: 1712 |
| ASSLRDSYEQY | SEQ ID NO: 1713 |
| ASSFNSNQPQH | SEQ ID NO: 1714 |
| ASSSGMNTEAF | SEQ ID NO: 1715 |
| ASSFDTEAF | SEQ ID NO: 1716 |
| ASSLDRTYEQY | SEQ ID NO: 1717 |
| SARTGNTEAF | SEQ ID NO: 1718 |

TABLE I-continued

| Sequence | Sequence ID No |
|---|---|
| ASSLFYEQY | SEQ ID NO: 1719 |
| ASSQNTDTQY | SEQ ID NO: 1720 |
| ASSRDRGNTEAF | SEQ ID NO: 1721 |
| ASSFGNTIY | SEQ ID NO: 1722 |
| ASSPDRVNTEAF | SEQ ID NO: 1723 |
| ASSQDRDTEAF | SEQ ID NO: 1724 |
| ASSPQGETQY | SEQ ID NO: 1725 |
| ASSGQGGNQPQH | SEQ ID NO: 1726 |
| ASSFGGSGNTIY | SEQ ID NO: 1727 |
| ASSFQGYEQY | SEQ ID NO: 1728 |
| ASSLRQETQY | SEQ ID NO: 1729 |
| ASSLLAGSTDTQY | SEQ ID NO: 1730 |
| ASSFGSSYNEQF | SEQ ID NO: 1731 |
| ASRGGTEAF | SEQ ID NO: 1732 |
| ASSFTGGTEAF | SEQ ID NO: 1733 |
| ASSLAGGGTEAF | SEQ ID NO: 1734 |
| ASSLFNEQF | SEQ ID NO: 1735 |
| ASSSTGELF | SEQ ID NO: 1736 |
| ASSFRNEQF | SEQ ID NO: 1737 |
| ASSFGDQPQH | SEQ ID NO: 1738 |
| ASSRGSSYNEQF | SEQ ID NO: 1739 |
| ASSLEYNEQF | SEQ ID NO: 1740 |
| ASSVGQNTEAF | SEQ ID NO: 1741 |
| ASSRDRDYEQY | SEQ ID NO: 1742 |
| ASSLTSGGYNEQF | SEQ ID NO: 1743 |
| ASSLTGGGTEAF | SEQ ID NO: 1744 |
| ASSLDNYGYT | SEQ ID NO: 1745 |
| ASSPGRSTDTQY | SEQ ID NO: 1746 |
| ASSPGQGSYNEQF | SEQ ID NO: 1747 |
| ASSPRGQETQY | SEQ ID NO: 1748 |
| ASSPTQETQY | SEQ ID NO: 1749 |
| ASSPGPSTDTQY | SEQ ID NO: 1750 |
| ASSSGTGNQPQH | SEQ ID NO: 1751 |
| ASSPSSGNTIY | SEQ ID NO: 1752 |
| ASSLGPNYGYT | SEQ ID NO: 1753 |
| ASSPGTLNTEAF | SEQ ID NO: 1754 |
| ASSLGLAGADTQY | SEQ ID NO: 1755 |
| ASSYGTDTQY | SEQ ID NO: 1756 |
| ASSLGLNEQF | SEQ ID NO: 1757 |
| ASSSTGGTDTQY | SEQ ID NO: 1758 |
| ASSLVGYNEQF | SEQ ID NO: 1759 |
| ASSFYSNQPQH | SEQ ID NO: 1760 |
| ASSLGLAGETQY | SEQ ID NO: 1761 |
| ASSQAETQY | SEQ ID NO: 1762 |
| ASSYSSNQPQH | SEQ ID NO: 1763 |
| ASSYDRNTEAF | SEQ ID NO: 1764 |
| ASSLLGEQY | SEQ ID NO: 1765 |
| ASSSGGSYEQY | SEQ ID NO: 1766 |
| ASSKNTEAF | SEQ ID NO: 1767 |
| ASRQGYEQY | SEQ ID NO: 1768 |
| ASSLGGNNEQF | SEQ ID NO: 1769 |
| ASSPPSYNEQF | SEQ ID NO: 1770 |
| ASSFSGSYEQY | SEQ ID NO: 1771 |
| ASSLVGGNEQF | SEQ ID NO: 1772 |
| ASSFLTDTQY | SEQ ID NO: 1773 |
| ASSWGTEAF | SEQ ID NO: 1774 |
| ASSFGGNYGYT | SEQ ID NO: 1775 |
| ASSGQGGTEAF | SEQ ID NO: 1776 |
| ASSPQGMNTEAF | SEQ ID NO: 1777 |
| ASSFGGLNTEAF | SEQ ID NO: 1778 |
| ASSSLSYEQY | SEQ ID NO: 1779 |
| ASSLLMNTEAF | SEQ ID NO: 1780 |
| ASSLVPNTEAF | SEQ ID NO: 1781 |
| ASSFAGNTEAF | SEQ ID NO: 1782 |
| ASSFGQGTDTQY | SEQ ID NO: 1783 |
| ASSLTGPYEQY | SEQ ID NO: 1784 |
| ASSFYTDTQY | SEQ ID NO: 1785 |
| ASSLRSSYNEQF | SEQ ID NO: 1786 |
| ASSLVGGSYEQY | SEQ ID NO: 1787 |
| ASSLGGPYNEQF | SEQ ID NO: 1788 |
| ASSFNTDTQY | SEQ ID NO: 1789 |
| ASSLGQGDGYT | SEQ ID NO: 1790 |
| ASSSGTYNEQF | SEQ ID NO: 1791 |
| ASSPTGGYGYT | SEQ ID NO: 1792 |
| ASSLATEAF | SEQ ID NO: 1793 |
| ASSPLGNEQF | SEQ ID NO: 1794 |
| ASSTQGNTEAF | SEQ ID NO: 1795 |
| ASSPDTEAF | SEQ ID NO: 1796 |

TABLE I-continued

| Sequence | Sequence ID No |
|---|---|
| ASSLDSGNTIY | SEQ ID NO: 1797 |
| ASSELAGGPDTQY | SEQ ID NO: 1798 |
| ASSPLQETQY | SEQ ID NO: 1799 |
| ASSLSGTGELF | SEQ ID NO: 1800 |
| ASSYSGNQPQH | SEQ ID NO: 1801 |
| ASSFGSYNEQF | SEQ ID NO: 1802 |
| ASSGTSTDTQY | SEQ ID NO: 1803 |
| ASSPPGQETQY | SEQ ID NO: 1804 |
| ASSPGLAGETQY | SEQ ID NO: 1805 |
| ASSLGGSNTEAF | SEQ ID NO: 1806 |
| ASRLTDTQY | SEQ ID NO: 1807 |
| ASRGGNQPQH | SEQ ID NO: 1808 |
| ASSQGGDTQY | SEQ ID NO: 1809 |
| ASSEGETQY | SEQ ID NO: 1810 |
| ASSFGGDTQY | SEQ ID NO: 1811 |
| ASSSIYEQY | SEQ ID NO: 1812 |
| ASSPRDSYEQY | SEQ ID NO: 1813 |
| ASSYSLNTEAF | SEQ ID NO: 1814 |
| ASSFPGNTEAF | SEQ ID NO: 1815 |
| ASSQVGYEQY | SEQ ID NO: 1816 |
| ASSLTQNTEAF | SEQ ID NO: 1817 |
| ASSLQDTQY | SEQ ID NO: 1818 |
| ASSPGQGNEKLF | SEQ ID NO: 1819 |
| ASSLGGANVLT | SEQ ID NO: 1820 |
| ASSRQMNTEAF | SEQ ID NO: 1821 |
| ASSLRDQPQH | SEQ ID NO: 1822 |
| ASSLQGSYNEQF | SEQ ID NO: 1823 |
| ASSPGGSSYNEQF | SEQ ID NO: 1824 |
| ASSLWGTEAF | SEQ ID NO: 1825 |
| ASSTGLNTEAF | SEQ ID NO: 1826 |
| ASSPDRGYEQY | SEQ ID NO: 1827 |
| ASSRQLNTEAF | SEQ ID NO: 1828 |
| ASSFGGSSYNEQF | SEQ ID NO: 1829 |
| ASSLGNNEQF | SEQ ID NO: 1830 |
| ASSPGRETQY | SEQ ID NO: 1831 |
| ASSSGGQPQH | SEQ ID NO: 1832 |
| ASSLNEKLF | SEQ ID NO: 1833 |
| ASSSGLSTDTQY | SEQ ID NO: 1834 |
| ASSLPYNEQF | SEQ ID NO: 1835 |
| ASSPQMNTEAF | SEQ ID NO: 1836 |
| ASSPGRMNTEAF | SEQ ID NO: 1837 |
| ASSRDRNYGYT | SEQ ID NO: 1838 |
| ASSFRVNTEAF | SEQ ID NO: 1839 |
| ASSLGRNNEQF | SEQ ID NO: 1840 |
| ASSLGQSSYEQY | SEQ ID NO: 1841 |
| ASSSMNTEAF | SEQ ID NO: 1842 |
| ASSSSSTDTQY | SEQ ID NO: 1843 |
| ASSRQGDTEAF | SEQ ID NO: 1844 |
| ASSLASGTDTQY | SEQ ID NO: 1845 |
| ASSLGQDYGYT | SEQ ID NO: 1846 |
| ASSPTGQETQY | SEQ ID NO: 1847 |
| ASSLQGDTQY | SEQ ID NO: 1848 |
| ASSPGANTEAF | SEQ ID NO: 1849 |
| ASSLGQGGYT | SEQ ID NO: 1850 |
| ASSLRGSSYEQY | SEQ ID NO: 1851 |
| ASSFGQPQH | SEQ ID NO: 1852 |
| ASSQDGYEQY | SEQ ID NO: 1853 |
| ASSAQGNTEAF | SEQ ID NO: 1854 |
| ASSLVGTGELF | SEQ ID NO: 1855 |
| ASSLNNQPQH | SEQ ID NO: 1856 |
| ASSSVYEQY | SEQ ID NO: 1857 |
| ASSRTGTDTQY | SEQ ID NO: 1858 |
| ASSYNTEAF | SEQ ID NO: 1859 |
| ASSLGGGEQF | SEQ ID NO: 1860 |
| ASSDYEQY | SEQ ID NO: 1861 |
| ASSPRGNQPQH | SEQ ID NO: 1862 |
| ASSPRMNTEAF | SEQ ID NO: 1863 |
| ASSPLGTEAF | SEQ ID NO: 1864 |
| ASSPRTGQETQY | SEQ ID NO: 1865 |
| ASSPTGNEQF | SEQ ID NO: 1866 |
| ASSPRNEQF | SEQ ID NO: 1867 |
| ASSYSGDTQY | SEQ ID NO: 1868 |
| ASSPQGDTQY | SEQ ID NO: 1869 |
| ASSPATDTQY | SEQ ID NO: 1870 |
| ASSLGTSSYNEQF | SEQ ID NO: 1871 |
| ASSLGRSSYNEQF | SEQ ID NO: 1872 |
| ASSFQGGTEAF | SEQ ID NO: 1873 |
| ASSPGGSSYEQY | SEQ ID NO: 1874 |

TABLE I-continued

| Sequence | Sequence ID No |
|---|---|
| ASSLAGGYGYT | SEQ ID NO: 1875 |
| ASSLSRNQPQH | SEQ ID NO: 1876 |
| SARGGNTEAF | SEQ ID NO: 1877 |
| ASSFTENTEAF | SEQ ID NO: 1878 |
| ASSFGANTEAF | SEQ ID NO: 1879 |
| ASSYGTEAF | SEQ ID NO: 1880 |
| ASSSGTGNTEAF | SEQ ID NO: 1881 |
| ASSLGATNEKLF | SEQ ID NO: 1882 |
| ASSLTGRTEAF | SEQ ID NO: 1883 |
| ASSLNMNTEAF | SEQ ID NO: 1884 |
| ASSDSSYEQY | SEQ ID NO: 1885 |
| ASSRQGLNTEAF | SEQ ID NO: 1886 |
| ASSFMNTEAF | SEQ ID NO: 1887 |
| ASSQGGYGYT | SEQ ID NO: 1888 |
| ASSLTGGSYNEQF | SEQ ID NO: 1889 |
| ASSLGGTYNEQF | SEQ ID NO: 1890 |
| ASSSLAGGYNEQF | SEQ ID NO: 1891 |
| ASSLQGSSYEQY | SEQ ID NO: 1892 |
| ASSLVSYNEQF | SEQ ID NO: 1893 |
| ASSYSGEQY | SEQ ID NO: 1894 |
| ASSLLLNTEAF | SEQ ID NO: 1895 |
| ASSLGGATDTQY | SEQ ID NO: 1896 |
| ASSLLAGSYNEQF | SEQ ID NO: 1897 |
| ASSQGANTEAF | SEQ ID NO: 1898 |
| ASSVGLNTEAF | SEQ ID NO: 1899 |
| ASSYLYEQY | SEQ ID NO: 1900 |
| ASSLGVSNQPQH | SEQ ID NO: 1901 |
| ASSWGQNTEAF | SEQ ID NO: 1902 |
| ASRTGGTDTQY | SEQ ID NO: 1903 |
| ASSVADTQY | SEQ ID NO: 1904 |
| ASSLDRGNEQF | SEQ ID NO: 1905 |
| ASSRGTGELF | SEQ ID NO: 1906 |
| ASRDSSYEQY | SEQ ID NO: 1907 |
| ASSVTGNTEAF | SEQ ID NO: 1908 |
| ASSSTANTEAF | SEQ ID NO: 1909 |
| ASSSLAGGTDTQY | SEQ ID NO: 1910 |
| ASSRGLQETQY | SEQ ID NO: 1911 |
| ASSLLGSTDTQY | SEQ ID NO: 1912 |
| ASSPDGYEQY | SEQ ID NO: 1913 |
| ASSLARDTQY | SEQ ID NO: 1914 |
| ASSLGGGADTQY | SEQ ID NO: 1915 |
| ASSQGSYNEQF | SEQ ID NO: 1916 |
| ASSLTGGETQY | SEQ ID NO: 1917 |
| ASSPGTTYEQY | SEQ ID NO: 1918 |
| ASSPGTANYGYT | SEQ ID NO: 1919 |
| ASSFSSGNTIY | SEQ ID NO: 1920 |
| ASSDRGNTEAF | SEQ ID NO: 1921 |
| ASSLAGGEQY | SEQ ID NO: 1922 |
| ASSPDRDTEAF | SEQ ID NO: 1923 |
| ASSPLNQPQH | SEQ ID NO: 1924 |
| ASSESSYEQY | SEQ ID NO: 1925 |
| ASSPGGGYEQY | SEQ ID NO: 1926 |
| ASRGQLNTEAF | SEQ ID NO: 1927 |
| ASSRTGNYGYT | SEQ ID NO: 1928 |
| ASSSNSYEQY | SEQ ID NO: 1929 |
| ASSLGTEETQY | SEQ ID NO: 1930 |
| ASSLVDTEAF | SEQ ID NO: 1931 |
| SARDSYEQY | SEQ ID NO: 1932 |
| ASSYSGTEAF | SEQ ID NO: 1933 |
| ASSLGTENTEAF | SEQ ID NO: 1934 |
| ASSYSSYNEQF | SEQ ID NO: 1935 |
| ASSWTENTEAF | SEQ ID NO: 1936 |
| ASSLGAGTDTQY | SEQ ID NO: 1937 |
| ASSPTSGSTDTQY | SEQ ID NO: 1938 |
| ASSPNYGYT | SEQ ID NO: 1939 |
| ASSRDRSTDTQY | SEQ ID NO: 1940 |
| ASSPQGDTEAF | SEQ ID NO: 1941 |
| ASSTNTEAF | SEQ ID NO: 1942 |
| ASSPGQNQPQH | SEQ ID NO: 1943 |
| ASSQVGNTEAF | SEQ ID NO: 1944 |
| ASSPLETQY | SEQ ID NO: 1945 |
| ASSDRDTGELF | SEQ ID NO: 1946 |
| ASSPTGGYEQY | SEQ ID NO: 1947 |
| ASSPTGYGYT | SEQ ID NO: 1948 |
| ASSVGGGTEAF | SEQ ID NO: 1949 |
| ASSFRGETQY | SEQ ID NO: 1950 |
| ASSLGLAAYNEQF | SEQ ID NO: 1951 |
| ASSLDGETQY | SEQ ID NO: 1952 |

TABLE I-continued

| Sequence | Sequence ID No |
|---|---|
| ASSDGYEQY | SEQ ID NO: 1953 |
| ASSPGLAYNEQF | SEQ ID NO: 1954 |
| ASSLIGETQY | SEQ ID NO: 1955 |
| ASSRGDTEAF | SEQ ID NO: 1956 |
| ASSSQMNTEAF | SEQ ID NO: 1957 |
| ASSQDRGTDTQY | SEQ ID NO: 1958 |
| ASSLTSGGTDTQY | SEQ ID NO: 1959 |
| ASSFGGSYNEQF | SEQ ID NO: 1960 |
| ASSLGPGELF | SEQ ID NO: 1961 |
| ASSQDGETQY | SEQ ID NO: 1962 |
| ASSLEGGQPQH | SEQ ID NO: 1963 |
| ASSPVNTEAF | SEQ ID NO: 1964 |
| ASSFGGQPQH | SEQ ID NO: 1965 |
| ASSYGLNTEAF | SEQ ID NO: 1966 |
| ASSPGTASYEQY | SEQ ID NO: 1967 |
| ASSLGRGNEQF | SEQ ID NO: 1968 |
| ASSLVGYGYT | SEQ ID NO: 1969 |
| ASSPTYEQY | SEQ ID NO: 1970 |
| ASSFRGYEQY | SEQ ID NO: 1971 |
| ASSLDGNTIY | SEQ ID NO: 1972 |
| ASSTGNQPQH | SEQ ID NO: 1973 |
| ASSAGETQY | SEQ ID NO: 1974 |
| ASSQGSSYEQY | SEQ ID NO: 1975 |
| ASSLRDSSYEQY | SEQ ID NO: 1976 |
| ASSLRQGTDTQY | SEQ ID NO: 1977 |
| ASSPGSGNTIY | SEQ ID NO: 1978 |
| ASSLQGGTDTQY | SEQ ID NO: 1979 |
| ASSLTGGQPQH | SEQ ID NO: 1980 |
| ASSLGVGTEAF | SEQ ID NO: 1981 |
| ASSPGTSGSYEQY | SEQ ID NO: 1982 |
| ASSRGYNEQF | SEQ ID NO: 1983 |
| ASSPPNTEAF | SEQ ID NO: 1984 |
| ASSLLAGAYNEQF | SEQ ID NO: 1985 |
| ASSPDRLNTEAF | SEQ ID NO: 1986 |
| ASSRAYEQY | SEQ ID NO: 1987 |
| ASSGGSNQPQH | SEQ ID NO: 1988 |
| ASSPGTGNYGYT | SEQ ID NO: 1989 |
| ASSQDRGNQPQH | SEQ ID NO: 1990 |
| ASSRTSGSYNEQF | SEQ ID NO: 1991 |
| ASSPGLAGGTDTQY | SEQ ID NO: 1992 |
| ASSLVTEAF | SEQ ID NO: 1993 |
| ASSLLENTEAF | SEQ ID NO: 1994 |
| ASSLTGGQETQY | SEQ ID NO: 1995 |
| ASSGYEQY | SEQ ID NO: 1996 |
| ASSLGQGSTEAF | SEQ ID NO: 1997 |
| ASSLAPYEQY | SEQ ID NO: 1998 |
| ASSFRGSYEQY | SEQ ID NO: 1999 |
| ASSLIYEQY | SEQ ID NO: 2000 |
| ASSFRGNEQF | SEQ ID NO: 2001 |
| ASSRDGNTEAF | SEQ ID NO: 2002 |
| ASSSGLAGGTDTQY | SEQ ID NO: 2003 |
| ASSFPGTDTQY | SEQ ID NO: 2004 |
| ASSFRGGTEAF | SEQ ID NO: 2005 |
| ASSLGQGDTEAF | SEQ ID NO: 2006 |
| ASSLLYNEQF | SEQ ID NO: 2007 |
| ASSEAYEQY | SEQ ID NO: 2008 |
| ASSLRGEQF | SEQ ID NO: 2009 |
| ASSFTVNTEAF | SEQ ID NO: 2010 |
| ASSLTGADTQY | SEQ ID NO: 2011 |
| ASSLVGSYNEQF | SEQ ID NO: 2012 |
| ASSPLSTDTQY | SEQ ID NO: 2013 |
| ASSGTYEQY | SEQ ID NO: 2014 |
| ASSSGGSTDTQY | SEQ ID NO: 2015 |
| ASSLSGMNTEAF | SEQ ID NO: 2016 |
| ASSPGTGYNEQF | SEQ ID NO: 2017 |
| ASSSGGEQY | SEQ ID NO: 2018 |
| ASSQGAYEQY | SEQ ID NO: 2019 |
| ASSLVGGYEQY | SEQ ID NO: 2020 |
| ASSGQGYGYT | SEQ ID NO: 2021 |
| ASSPGTAYNEQF | SEQ ID NO: 2022 |
| ASSDSSTDTQY | SEQ ID NO: 2023 |
| ASSQVNEQF | SEQ ID NO: 2024 |
| ASSLAGGAYEQY | SEQ ID NO: 2025 |
| ASSLGRDYEQY | SEQ ID NO: 2026 |
| ASSLGFTDTQY | SEQ ID NO: 2027 |
| ASSLGWNTEAF | SEQ ID NO: 2028 |
| ASSLGLNTGELF | SEQ ID NO: 2029 |
| ASSFRYEQY | SEQ ID NO: 2030 |

TABLE I-continued

| Sequence | Sequence ID No |
|---|---|
| ASSPGQANTEAF | SEQ ID NO: 2031 |
| ASSGGNTEAF | SEQ ID NO: 2032 |
| ASSLAGRETQY | SEQ ID NO: 2033 |
| ASSFGQETQY | SEQ ID NO: 2034 |
| ASSLAGGPTDTQY | SEQ ID NO: 2035 |
| ASSYTGELF | SEQ ID NO: 2036 |
| SARQGNQPQH | SEQ ID NO: 2037 |
| ASSFSGNEQF | SEQ ID NO: 2038 |
| ASSLEGYNEQF | SEQ ID NO: 2039 |
| ASSPGDYGYT | SEQ ID NO: 2040 |
| SARTGNQPQH | SEQ ID NO: 2041 |
| ASSRDRDTEAF | SEQ ID NO: 2042 |
| ASSVGYEQY | SEQ ID NO: 2043 |
| ASSGGGTDTQY | SEQ ID NO: 2044 |
| ASSLEGDQPQH | SEQ ID NO: 2045 |
| SARLAGGQETQY | SEQ ID NO: 2046 |
| ASSGGSSYNEQF | SEQ ID NO: 2047 |
| ASSSSGTDTQY | SEQ ID NO: 2048 |
| ASSQTVNTEAF | SEQ ID NO: 2049 |
| ASSEGNTEAF | SEQ ID NO: 2050 |
| ASSSLDTQY | SEQ ID NO: 2051 |
| ASSQGQGAYEQY | SEQ ID NO: 2052 |
| ASSLGQRNTEAF | SEQ ID NO: 2053 |
| ASSFSENTEAF | SEQ ID NO: 2054 |
| ASSSGGDTQY | SEQ ID NO: 2055 |
| ASSLDSMNTEAF | SEQ ID NO: 2056 |
| SARQGNTEAF | SEQ ID NO: 2057 |
| ASSLGLAQETQY | SEQ ID NO: 2058 |
| ASSQNNEQF | SEQ ID NO: 2059 |
| ASSLGRSNQPQH | SEQ ID NO: 2060 |
| ASSLGPNEQF | SEQ ID NO: 2061 |
| ASSSPGTDTQY | SEQ ID NO: 2062 |
| ASSFSRNTEAF | SEQ ID NO: 2063 |
| ASSPGGQPQH | SEQ ID NO: 2064 |
| ASSSQGSNQPQH | SEQ ID NO: 2065 |
| ASSPLGYEQY | SEQ ID NO: 2066 |
| ASSLDYGYT | SEQ ID NO: 2067 |
| ASSLSGTYEQY | SEQ ID NO: 2068 |
| ASSSGTAYEQY | SEQ ID NO: 2069 |
| ASSRQVNTEAF | SEQ ID NO: 2070 |
| ASSLDRGPYEQY | SEQ ID NO: 2071 |
| ASSLQGQPQH | SEQ ID NO: 2072 |
| ASSLSGGETQY | SEQ ID NO: 2073 |
| ASSRGGQETQY | SEQ ID NO: 2074 |
| ASSRDRGSYEQY | SEQ ID NO: 2075 |
| ASRSSGNTIY | SEQ ID NO: 2076 |
| ASSSGLAGYNEQF | SEQ ID NO: 2077 |
| ASSLQGRNTEAF | SEQ ID NO: 2078 |
| ASSLEGYTEAF | SEQ ID NO: 2079 |
| ASSPGLAGNEQF | SEQ ID NO: 2080 |
| ASSLQGPNTEAF | SEQ ID NO: 2081 |
| ASSRDRGTEAF | SEQ ID NO: 2082 |
| ASSEGTDTQY | SEQ ID NO: 2083 |
| ASSFGQNYGYT | SEQ ID NO: 2084 |
| ASSGTSGYNEQF | SEQ ID NO: 2085 |
| ASSATGNTEAF | SEQ ID NO: 2086 |
| ASSLVGGQETQY | SEQ ID NO: 2087 |
| ASSPTGSTDTQY | SEQ ID NO: 2088 |
| ASSLGDSSYEQY | SEQ ID NO: 2089 |
| ASSLGTNQPQH | SEQ ID NO: 2090 |
| ASSLQGAGTEAF | SEQ ID NO: 2091 |
| ASSRQGAYEQY | SEQ ID NO: 2092 |
| ASSFNNEQF | SEQ ID NO: 2093 |
| ASSFGYNEQF | SEQ ID NO: 2094 |
| ASSWTANTEAF | SEQ ID NO: 2095 |
| ASSPGQGGQPQH | SEQ ID NO: 2096 |
| ASSFGGMNTEAF | SEQ ID NO: 2097 |
| ASSLKNTEAF | SEQ ID NO: 2098 |
| ASSRRETQY | SEQ ID NO: 2099 |
| ASSLEPNTEAF | SEQ ID NO: 2100 |
| ASSFDNEQF | SEQ ID NO: 2101 |
| ASSFLNEQF | SEQ ID NO: 2102 |
| ASSRDSNTEAF | SEQ ID NO: 2103 |
| ASSSSGYEQY | SEQ ID NO: 2104 |
| ASSPPGADTQY | SEQ ID NO: 2105 |
| ASSLSGDQPQH | SEQ ID NO: 2106 |
| ASSLENQPQH | SEQ ID NO: 2107 |
| ASSLRNTGELF | SEQ ID NO: 2108 |

TABLE I-continued

| Sequence | Sequence ID No |
|---|---|
| ASSPGQGTEAF | SEQ ID NO: 2109 |
| ASSSGAYEQY | SEQ ID NO: 2110 |
| ASSQGSGNTIY | SEQ ID NO: 2111 |
| ASSPQGYGYT | SEQ ID NO: 2112 |
| ASSLGPNNEQF | SEQ ID NO: 2113 |
| ASSSQENTEAF | SEQ ID NO: 2114 |
| ASSYSSTDTQY | SEQ ID NO: 2115 |
| ASSLQGETQY | SEQ ID NO: 2116 |
| ASSLQGATEAF | SEQ ID NO: 2117 |
| ASSLLSNQPQH | SEQ ID NO: 2118 |
| ASTGNTEAF | SEQ ID NO: 2119 |
| ASRGSSYNEQF | SEQ ID NO: 2120 |
| ASSPGSDTQY | SEQ ID NO: 2121 |
| ASGQETQY | SEQ ID NO: 2122 |
| ASSLDRSSYEQY | SEQ ID NO: 2123 |
| ASSQGDQPQH | SEQ ID NO: 2124 |
| ASSLGGGDTQY | SEQ ID NO: 2125 |
| ASRRGNTEAF | SEQ ID NO: 2126 |
| ASSPDSSNQPQH | SEQ ID NO: 2127 |
| ASSLTADTQY | SEQ ID NO: 2128 |
| ASSLQNTGELF | SEQ ID NO: 2129 |
| ASSSSQETQY | SEQ ID NO: 2130 |
| ASSPGLAGDTQY | SEQ ID NO: 2131 |
| ASSDRYEQY | SEQ ID NO: 2132 |
| ASRGQGTDTQY | SEQ ID NO: 2133 |
| ASSSNSNQPQH | SEQ ID NO: 2134 |
| ASSPGGTQY | SEQ ID NO: 2135 |
| ASSRDRSSYEQY | SEQ ID NO: 2136 |
| ASSLEGGTDTQY | SEQ ID NO: 2137 |
| ASSFRGQETQY | SEQ ID NO: 2138 |
| ASSRDRTYEQY | SEQ ID NO: 2139 |
| ASSPQGANTEAF | SEQ ID NO: 2140 |
| ASRDSYEQY | SEQ ID NO: 2141 |
| ASSLGTGNYGYT | SEQ ID NO: 2142 |
| ASSPRGPDTQY | SEQ ID NO: 2143 |
| ASSDTYEQY | SEQ ID NO: 2144 |
| ASSYGNEQF | SEQ ID NO: 2145 |
| ASSLGTANYGYT | SEQ ID NO: 2146 |
| ASSDRGYEQY | SEQ ID NO: 2147 |
| ASSQTGGTEAF | SEQ ID NO: 2148 |
| ASSPGLAGGNEQF | SEQ ID NO: 2149 |
| ASSQGGEQF | SEQ ID NO: 2150 |
| ASSLSGLNTEAF | SEQ ID NO: 2151 |
| ASSRGGYEQY | SEQ ID NO: 2152 |
| ASSPRTSTDTQY | SEQ ID NO: 2153 |
| ASSVGNTEAF | SEQ ID NO: 2154 |
| ASSSGLAGTDTQY | SEQ ID NO: 2155 |
| ASSLGGGSTDTQY | SEQ ID NO: 2156 |
| ASSPTGSSYEQY | SEQ ID NO: 2157 |
| ASSRGADTQY | SEQ ID NO: 2158 |
| ASSLGPNTGELF | SEQ ID NO: 2159 |
| ASSLARGTEAF | SEQ ID NO: 2160 |
| ASSPDRAYEQY | SEQ ID NO: 2161 |
| ASSQVADTQY | SEQ ID NO: 2162 |
| ASRGETQY | SEQ ID NO: 2163 |
| ASSEGSNQPQH | SEQ ID NO: 2164 |
| ASRGGTDTQY | SEQ ID NO: 2165 |
| ASSFSGQETQY | SEQ ID NO: 2166 |
| ASSFDSYEQY | SEQ ID NO: 2167 |
| ASSIGGTEAF | SEQ ID NO: 2168 |
| ASSPGLAEETQY | SEQ ID NO: 2169 |
| ASSAAYEQY | SEQ ID NO: 2170 |
| ASSFSGELF | SEQ ID NO: 2171 |
| ASSLSPSYEQY | SEQ ID NO: 2172 |
| ASSLGQGNEKLF | SEQ ID NO: 2173 |
| ASSLGGASTDTQY | SEQ ID NO: 2174 |
| ASSSTGSYEQY | SEQ ID NO: 2175 |
| ASSPLDTQY | SEQ ID NO: 2176 |
| ASSSGQMNTEAF | SEQ ID NO: 2177 |
| ASSPPGNEQF | SEQ ID NO: 2178 |
| ASSQGPDTQY | SEQ ID NO: 2179 |
| ASSGGSYEQY | SEQ ID NO: 2180 |
| ASSLGLAYNEQF | SEQ ID NO: 2181 |
| ASSNSNQPQH | SEQ ID NO: 2182 |
| ASRNTGELF | SEQ ID NO: 2183 |
| ASSRSYNEQF | SEQ ID NO: 2184 |
| ASSQVTDTQY | SEQ ID NO: 2185 |
| ASSLGGNEQY | SEQ ID NO: 2186 |

TABLE I-continued

| Sequence | Sequence ID No |
|---|---|
| ASSSSETQY | SEQ ID NO: 2187 |
| ASSQVNTEAF | SEQ ID NO: 2188 |
| ASSPPGQGYEQY | SEQ ID NO: 2189 |
| ASSYSENTEAF | SEQ ID NO: 2190 |
| SARGGYEQY | SEQ ID NO: 2191 |
| ASSLRDEQY | SEQ ID NO: 2192 |
| ASSPGQVNTEAF | SEQ ID NO: 2193 |
| ASSLTGEETQY | SEQ ID NO: 2194 |
| ASSSRNTEAF | SEQ ID NO: 2195 |
| ASSFRSTDTQY | SEQ ID NO: 2196 |
| ASSFTGELF | SEQ ID NO: 2197 |
| ASSYSRGTEAF | SEQ ID NO: 2198 |
| ASSFAYEQY | SEQ ID NO: 2199 |
| ASSRQGNYGYT | SEQ ID NO: 2200 |
| ASSYSYNEQF | SEQ ID NO: 2201 |
| ASSLQGNTGELF | SEQ ID NO: 2202 |
| ASSPRTANTEAF | SEQ ID NO: 2203 |
| ASSPGTTDTQY | SEQ ID NO: 2204 |
| ASGYNEQF | SEQ ID NO: 2205 |
| ASSLGNTDTQY | SEQ ID NO: 2206 |
| ASSSGTSGTDTQY | SEQ ID NO: 2207 |
| ASSQDRAYEQY | SEQ ID NO: 2208 |
| ASSTGTDTQY | SEQ ID NO: 2209 |
| ASSQEGYEQY | SEQ ID NO: 2210 |
| ASSLGVDTQY | SEQ ID NO: 2211 |
| ASSPTSGGYNEQF | SEQ ID NO: 2212 |
| ASSLDGDTQY | SEQ ID NO: 2213 |
| ASSATYEQY | SEQ ID NO: 2214 |
| ASSPPYNEQF | SEQ ID NO: 2215 |
| ASSLTNQPQH | SEQ ID NO: 2216 |
| ASSLTAYEQY | SEQ ID NO: 2217 |
| ASSQGGNQPQH | SEQ ID NO: 2218 |
| ASSLVGGETQY | SEQ ID NO: 2219 |
| ASSRQGQETQY | SEQ ID NO: 2220 |
| ASSLSGAYEQY | SEQ ID NO: 2221 |
| ASSSGLYNEQF | SEQ ID NO: 2222 |
| ASSLMGNTEAF | SEQ ID NO: 2223 |
| ASRNTDTQY | SEQ ID NO: 2224 |
| ASSLGGSDTQY | SEQ ID NO: 2225 |
| ASSPPQETQY | SEQ ID NO: 2226 |
| ASSLTGTNTEAF | SEQ ID NO: 2227 |
| ASSLASGSYEQY | SEQ ID NO: 2228 |
| ASSLEGDTEAF | SEQ ID NO: 2229 |
| ASSQDRGYGYT | SEQ ID NO: 2230 |
| ASSLASGNTIY | SEQ ID NO: 2231 |
| ASSPGGMNTEAF | SEQ ID NO: 2232 |
| ASSTTGNTEAF | SEQ ID NO: 2233 |
| ASSFRNQPQH | SEQ ID NO: 2234 |
| ASSPGSSGNTIY | SEQ ID NO: 2235 |
| ASSLSGGYNEQF | SEQ ID NO: 2236 |
| ASSLRQGYEQY | SEQ ID NO: 2237 |
| ASRGSGNTIY | SEQ ID NO: 2238 |
| ASSRTTDTQY | SEQ ID NO: 2239 |
| ASSSGQGPYEQY | SEQ ID NO: 2240 |
| ASSGSYNEQF | SEQ ID NO: 2241 |
| ASSQGQNYGYT | SEQ ID NO: 2242 |
| ASSLLGGTDTQY | SEQ ID NO: 2243 |
| ASSLVTGELF | SEQ ID NO: 2244 |
| ASSLGQGGYGYT | SEQ ID NO: 2245 |
| ASSPGTSSYEQY | SEQ ID NO: 2246 |
| ASSTNTGELF | SEQ ID NO: 2247 |
| ASSSRGTEAF | SEQ ID NO: 2248 |
| ASSPGPDTQY | SEQ ID NO: 2249 |
| ASRGTEAF | SEQ ID NO: 2250 |
| ASSQGQGNTEAF | SEQ ID NO: 2251 |
| ASSLRPNTEAF | SEQ ID NO: 2252 |
| ASSLDRNEQF | SEQ ID NO: 2253 |
| ASSPDRYEQY | SEQ ID NO: 2254 |
| ASSSQVNTEAF | SEQ ID NO: 2255 |
| ASSLMETQY | SEQ ID NO: 2256 |
| ASSSGNYGYT | SEQ ID NO: 2257 |
| ASSSDSTDTQY | SEQ ID NO: 2258 |
| ASSSQGDTEAF | SEQ ID NO: 2259 |
| ASSLDRSSYNEQF | SEQ ID NO: 2260 |
| ASSFAETQY | SEQ ID NO: 2261 |
| ASSSGGSNQPQH | SEQ ID NO: 2262 |
| ASSLAVQETQY | SEQ ID NO: 2263 |
| ASSRTGGNTEAF | SEQ ID NO: 2264 |

TABLE I-continued

| Sequence | Sequence ID No |
|---|---|
| ASSLQGTGELF | SEQ ID NO: 2265 |
| ASSSTGSNQPQH | SEQ ID NO: 2266 |
| ASSYSGGYEQY | SEQ ID NO: 2267 |
| ASSRDYNEQF | SEQ ID NO: 2268 |
| ASSLDQNTEAF | SEQ ID NO: 2269 |
| ASSPPGYEQY | SEQ ID NO: 2270 |
| ASSRTGDQPQH | SEQ ID NO: 2271 |
| ASSLLRNTEAF | SEQ ID NO: 2272 |
| ASSYGGYEQY | SEQ ID NO: 2273 |
| ASSEGYGYT | SEQ ID NO: 2274 |
| ASSQGDYGYT | SEQ ID NO: 2275 |
| ASSPTGSGNTIY | SEQ ID NO: 2276 |
| ASSRDQETQY | SEQ ID NO: 2277 |
| ASSLGGPTDTQY | SEQ ID NO: 2278 |
| ASSPLGTDTQY | SEQ ID NO: 2279 |
| ASSLGGVTEAF | SEQ ID NO: 2280 |
| ASSADSNQPQH | SEQ ID NO: 2281 |
| ASSLEGGNTEAF | SEQ ID NO: 2282 |
| ASSPGTDYEQY | SEQ ID NO: 2283 |
| ASSLGRNTGELF | SEQ ID NO: 2284 |
| ASSYGGSYEQY | SEQ ID NO: 2285 |
| ASSLGNYEQY | SEQ ID NO: 2286 |
| ASSLTGANVLT | SEQ ID NO: 2287 |
| ASSSTGYGYT | SEQ ID NO: 2288 |
| ASSPGTGSYNEQF | SEQ ID NO: 2289 |
| ASGTYEQY | SEQ ID NO: 2290 |
| ASSLVNTGELF | SEQ ID NO: 2291 |
| ASSFGQQETQY | SEQ ID NO: 2292 |
| ASSLAGSQETQY | SEQ ID NO: 2293 |
| ASSPTGGNTEAF | SEQ ID NO: 2294 |
| ASSLVGLNTEAF | SEQ ID NO: 2295 |
| ASRGQETQY | SEQ ID NO: 2296 |
| ASSFPSTDTQY | SEQ ID NO: 2297 |
| ASSSDRGYEQY | SEQ ID NO: 2298 |
| ASSPTGTYEQY | SEQ ID NO: 2299 |
| ASSAGNTEAF | SEQ ID NO: 2300 |
| ASSRDGYEQY | SEQ ID NO: 2301 |
| ASSLGRADTQY | SEQ ID NO: 2302 |
| ASSLEGADTQY | SEQ ID NO: 2303 |
| ASSPTSGTDTQY | SEQ ID NO: 2304 |
| ASSFGTANTEAF | SEQ ID NO: 2305 |
| ASSLKGYEQY | SEQ ID NO: 2306 |
| ASSLYRNTEAF | SEQ ID NO: 2307 |
| ASSLAGPDTQY | SEQ ID NO: 2308 |
| ASSPRRNTEAF | SEQ ID NO: 2309 |
| ASSLTGGNEQF | SEQ ID NO: 2310 |
| ASRKNTEAF | SEQ ID NO: 2311 |
| ASSQDSTDTQY | SEQ ID NO: 2312 |
| ASSLVGNTIY | SEQ ID NO: 2313 |
| ASSPGLNQPQH | SEQ ID NO: 2314 |
| ASSSGTSYEQY | SEQ ID NO: 2315 |
| ASSLQGRTEAF | SEQ ID NO: 2316 |
| ASSLDRADTQY | SEQ ID NO: 2317 |
| ASSPQGSYEQY | SEQ ID NO: 2318 |
| ASSPTGSSYNEQF | SEQ ID NO: 2319 |
| ASRDYNEQF | SEQ ID NO: 2320 |
| ASSSGPYNEQF | SEQ ID NO: 2321 |
| ASSIQGNTEAF | SEQ ID NO: 2322 |
| ASSRGGSYNEQF | SEQ ID NO: 2323 |
| ASSYSGGNTEAF | SEQ ID NO: 2324 |
| ASSRNYEQY | SEQ ID NO: 2325 |
| ASSVDRNTEAF | SEQ ID NO: 2326 |
| ASSHSTDTQY | SEQ ID NO: 2327 |
| ASSFGTGGYEQY | SEQ ID NO: 2328 |
| ASSPGTAGNTIY | SEQ ID NO: 2329 |
| ASSLGHQETQY | SEQ ID NO: 2330 |
| ASSLGGAGNTIY | SEQ ID NO: 2331 |
| ASSLARNEQF | SEQ ID NO: 2332 |
| ASSLEGYSNQPQH | SEQ ID NO: 2333 |
| ASSSLNEQF | SEQ ID NO: 2334 |
| ASSFPDTQY | SEQ ID NO: 2335 |
| ASSQGENTEAF | SEQ ID NO: 2336 |
| ASSPQGSGNTIY | SEQ ID NO: 2337 |
| ASSPGDTEAF | SEQ ID NO: 2338 |
| ASSQDRGNEQF | SEQ ID NO: 2339 |
| ASSPTGDQPQH | SEQ ID NO: 2340 |
| ASSYSRGYEQY | SEQ ID NO: 2341 |
| ASSLLGDTEAF | SEQ ID NO: 2342 |

TABLE I-continued

| Sequence | Sequence ID No |
|---|---|
| ASRRTGNTEAF | SEQ ID NO: 2343 |
| ASSLLAGYNEQF | SEQ ID NO: 2344 |
| ASSLAGASTDTQY | SEQ ID NO: 2345 |
| ASSLTGPNTEAF | SEQ ID NO: 2346 |
| ASSFSGTEAF | SEQ ID NO: 2347 |
| ASSLQGAGNTIY | SEQ ID NO: 2348 |
| ASSLGGSQPQH | SEQ ID NO: 2349 |
| ASSDRGTDTQY | SEQ ID NO: 2350 |
| ASSLAGAQETQY | SEQ ID NO: 2351 |
| ASSLSYGYT | SEQ ID NO: 2352 |
| ASSLEGNTIY | SEQ ID NO: 2353 |
| ASSLAGGTGELF | SEQ ID NO: 2354 |
| ASSPGQGGNQPQH | SEQ ID NO: 2355 |
| ASSLGLAGVNEQF | SEQ ID NO: 2356 |
| ASSLLGSYEQY | SEQ ID NO: 2357 |
| ASSSGGNEQF | SEQ ID NO: 2358 |
| ASSPSSNQPQH | SEQ ID NO: 2359 |
| ASSGTSGTDTQY | SEQ ID NO: 2360 |
| ASRSSTDTQY | SEQ ID NO: 2361 |
| ASSPGRNQPQH | SEQ ID NO: 2362 |
| ASSYSGSYEQY | SEQ ID NO: 2363 |
| ASSFNYEQY | SEQ ID NO: 2364 |
| ASSVGSNQPQH | SEQ ID NO: 2365 |
| ASSTDRNTEAF | SEQ ID NO: 2366 |
| SARGSNQPQH | SEQ ID NO: 2367 |
| ASSLGQSNTEAF | SEQ ID NO: 2368 |
| ASSPGEETQY | SEQ ID NO: 2369 |
| ASSLAPTDTQY | SEQ ID NO: 2370 |
| ASSQDRYEQY | SEQ ID NO: 2371 |
| ASSRYSNQPQH | SEQ ID NO: 2372 |
| ASSLAGGTYNEQF | SEQ ID NO: 2373 |
| ASSYSVNTEAF | SEQ ID NO: 2374 |
| ASRGQMNTEAF | SEQ ID NO: 2375 |
| ASSYRGTDTQY | SEQ ID NO: 2376 |
| ASSLGGGSNQPQH | SEQ ID NO: 2377 |
| ASSPRSYEQY | SEQ ID NO: 2378 |
| ASSLGTASYEQY | SEQ ID NO: 2379 |
| ASSPRQGNQPQH | SEQ ID NO: 2380 |
| ASSSQGYGYT | SEQ ID NO: 2381 |
| ASSLDLTDTQY | SEQ ID NO: 2382 |
| ASSLDRGEQY | SEQ ID NO: 2383 |
| ASSYSNTEAF | SEQ ID NO: 2384 |
| ASSPRGGNQPQH | SEQ ID NO: 2385 |
| ASSLGVSGNTIY | SEQ ID NO: 2386 |
| ASSSGQAYEQY | SEQ ID NO: 2387 |
| ASSYGGTDTQY | SEQ ID NO: 2388 |
| ASSPTGGSYEQY | SEQ ID NO: 2389 |
| ASSLVAGGTDTQY | SEQ ID NO: 2390 |
| ASSRGQGYEQY | SEQ ID NO: 2391 |
| ASSRDRVNTEAF | SEQ ID NO: 2392 |
| ASSYSGSSYNEQF | SEQ ID NO: 2393 |
| ASRGSYEQY | SEQ ID NO: 2394 |
| ASSQTGYEQY | SEQ ID NO: 2395 |
| ASSYGSYEQY | SEQ ID NO: 2396 |
| ASSPLADTQY | SEQ ID NO: 2397 |
| ASSLGLAGGQETQY | SEQ ID NO: 2398 |
| ASSSGSGNTIY | SEQ ID NO: 2399 |
| ASSRDLNTEAF | SEQ ID NO: 2400 |
| ASSQDSSYEQY | SEQ ID NO: 2401 |
| ASSPRTVNTEAF | SEQ ID NO: 2402 |
| ASSPTGVNTEAF | SEQ ID NO: 2403 |
| ASRGSGANVLT | SEQ ID NO: 2404 |
| ASSLNGNQPQH | SEQ ID NO: 2405 |
| ASSLGQKETQY | SEQ ID NO: 2406 |
| ASSLAASYEQY | SEQ ID NO: 2407 |
| ASSLWGNEQF | SEQ ID NO: 2408 |
| ASSLVGSGNTIY | SEQ ID NO: 2409 |
| ASSLRGYNEQF | SEQ ID NO: 2410 |
| ASSQSSYNEQF | SEQ ID NO: 2411 |
| ASSSTGLNTEAF | SEQ ID NO: 2412 |
| ASSLAGGGETQY | SEQ ID NO: 2413 |
| ASSFQENTEAF | SEQ ID NO: 2414 |
| ASSELAGGTDTQY | SEQ ID NO: 2415 |
| ASSPGTVQETQY | SEQ ID NO: 2416 |
| ASSLEGSSYNEQF | SEQ ID NO: 2417 |
| ASSLPGQPQH | SEQ ID NO: 2418 |
| ASSERETQY | SEQ ID NO: 2419 |
| ASSLGTSGSYEQY | SEQ ID NO: 2420 |

TABLE I-continued

| Sequence | Sequence ID No |
|---|---|
| ASSQGQETQY | SEQ ID NO: 2421 |
| ASSYSGGNQPQH | SEQ ID NO: 2422 |
| ASRRQGNTEAF | SEQ ID NO: 2423 |
| ASSLQGPYEQY | SEQ ID NO: 2424 |
| ASSPRDTEAF | SEQ ID NO: 2425 |
| ASSSITDTQY | SEQ ID NO: 2426 |
| ASSLRQGGTEAF | SEQ ID NO: 2427 |
| ASSLDRGNSPLH | SEQ ID NO: 2428 |
| ASSQGQGYGYT | SEQ ID NO: 2429 |
| ASSPRGSTDTQY | SEQ ID NO: 2430 |
| ASSTGSYEQY | SEQ ID NO: 2431 |
| ASSEGLNTEAF | SEQ ID NO: 2432 |
| ASSPRSSYEQY | SEQ ID NO: 2433 |
| ASSRGSGNTIY | SEQ ID NO: 2434 |
| ASSSDSYGYT | SEQ ID NO: 2435 |
| ASSLAGGRETQY | SEQ ID NO: 2436 |
| ASSQVGNEQF | SEQ ID NO: 2437 |
| ASSPGRSYEQY | SEQ ID NO: 2438 |
| ASSLAGSTEAF | SEQ ID NO: 2439 |
| ASSLQGDYGYT | SEQ ID NO: 2440 |
| ASSLGRGETQY | SEQ ID NO: 2441 |
| ASSLLAGGPDTQY | SEQ ID NO: 2442 |
| ASSYSGSSYEQY | SEQ ID NO: 2443 |
| ASSLGGNSPLH | SEQ ID NO: 2444 |
| ASSPGRQETQY | SEQ ID NO: 2445 |
| ASSPGLGTDTQY | SEQ ID NO: 2446 |
| ASSFGSQETQY | SEQ ID NO: 2447 |
| ASSLDTQY | SEQ ID NO: 2448 |
| ASSPPGGTEAF | SEQ ID NO: 2449 |
| ASSQSDTQY | SEQ ID NO: 2450 |
| ASSPAETQY | SEQ ID NO: 2451 |
| ASSEEETQY | SEQ ID NO: 2452 |
| ASSSPYNEQF | SEQ ID NO: 2453 |
| ASSLQGTYEQY | SEQ ID NO: 2454 |
| ASSSTGTDTQY | SEQ ID NO: 2455 |
| ASSAGTDTQY | SEQ ID NO: 2456 |
| ASSSYTGELF | SEQ ID NO: 2457 |
| ASSLSGEQF | SEQ ID NO: 2458 |
| ASSLGPMNTEAF | SEQ ID NO: 2459 |
| SASGSTDTQY | SEQ ID NO: 2460 |
| ASSLAATDTQY | SEQ ID NO: 2461 |
| ASSPTGYNEQF | SEQ ID NO: 2462 |
| ASSFSTEAF | SEQ ID NO: 2463 |
| ASSRQGTEAF | SEQ ID NO: 2464 |
| ASSLGGPEAF | SEQ ID NO: 2465 |
| ASRDRGTDTQY | SEQ ID NO: 2466 |
| ASSLADSYEQY | SEQ ID NO: 2467 |
| ASSLGTDYEQY | SEQ ID NO: 2468 |
| ASSPITDTQY | SEQ ID NO: 2469 |
| ASSLGQGSTDTQY | SEQ ID NO: 2470 |
| ASSSSGSSYEQY | SEQ ID NO: 2471 |
| ASSLGTAYGYT | SEQ ID NO: 2472 |
| ASSLLSSYNEQF | SEQ ID NO: 2473 |
| ASSPHNEQF | SEQ ID NO: 2474 |
| ASSLARGTDTQY | SEQ ID NO: 2475 |
| ASSLGDSTDTQY | SEQ ID NO: 2476 |
| ASSLEGSSYEQY | SEQ ID NO: 2477 |
| ASSVGGTDTQY | SEQ ID NO: 2478 |
| ASSPGTENTEAF | SEQ ID NO: 2479 |
| ASSLVRTDTQY | SEQ ID NO: 2480 |
| ASSYSGNEQF | SEQ ID NO: 2481 |
| ASSFGGGNQPQH | SEQ ID NO: 2482 |
| ASSQGRNQPQH | SEQ ID NO: 2483 |
| ASSPGLYEQY | SEQ ID NO: 2484 |
| ASSRTGGSYEQY | SEQ ID NO: 2485 |
| ASSLGATEAF | SEQ ID NO: 2486 |
| ASSLSSNTEAF | SEQ ID NO: 2487 |
| ASSPGYQETQY | SEQ ID NO: 2488 |
| ASSPGVQETQY | SEQ ID NO: 2489 |
| ASSLGAGTEAF | SEQ ID NO: 2490 |
| ASSGGSYNEQF | SEQ ID NO: 2491 |
| ASSLSNSPLH | SEQ ID NO: 2492 |
| ASSLGGTNTEAF | SEQ ID NO: 2493 |
| ASSLSTYEQY | SEQ ID NO: 2494 |
| ASSRRNTEAF | SEQ ID NO: 2495 |
| ASSTGETQY | SEQ ID NO: 2496 |
| ASSLAGTSYEQY | SEQ ID NO: 2497 |
| ASSPGQTNTEAF | SEQ ID NO: 2498 |

TABLE I-continued

| Sequence | Sequence ID No |
|---|---|
| ASSGGGNQPQH | SEQ ID NO: 2499 |
| ASSYTGNTEAF | SEQ ID NO: 2500 |
| ASSPSSGANVLT | SEQ ID NO: 2501 |
| ASSLTGAGNTIY | SEQ ID NO: 2502 |
| ASSYGQGYEQY | SEQ ID NO: 2503 |
| ASSGGETQY | SEQ ID NO: 2504 |
| ASSQVLNTEAF | SEQ ID NO: 2505 |
| ASSLSGPYEQY | SEQ ID NO: 2506 |
| ASSQGTYEQY | SEQ ID NO: 2507 |
| ASSRNTDTQY | SEQ ID NO: 2508 |
| ASSLTGSYGYT | SEQ ID NO: 2509 |
| ASSQGLNQPQH | SEQ ID NO: 2510 |
| ASSQGGSYEQY | SEQ ID NO: 2511 |
| ASSYGGTEAF | SEQ ID NO: 2512 |
| ASSPDRGSYEQY | SEQ ID NO: 2513 |
| ASSSGTGYEQY | SEQ ID NO: 2514 |
| ASSLDRSNQPQH | SEQ ID NO: 2515 |
| ASSLVAYEQY | SEQ ID NO: 2516 |
| SARRETQY | SEQ ID NO: 2517 |
| ASSSRGNEQF | SEQ ID NO: 2518 |
| ASSLEGMNTEAF | SEQ ID NO: 2519 |
| ASSQQGNQPQH | SEQ ID NO: 2520 |
| ASSLGQLYEQY | SEQ ID NO: 2521 |
| ASSPGGLNTEAF | SEQ ID NO: 2522 |
| ASSPGPTDTQY | SEQ ID NO: 2523 |
| ASSLIDTQY | SEQ ID NO: 2524 |
| ASSHYNEQF | SEQ ID NO: 2525 |
| ASSSGTGPYEQY | SEQ ID NO: 2526 |
| ASSRDTGELF | SEQ ID NO: 2527 |
| ASSLALETQY | SEQ ID NO: 2528 |
| ASSPGGADTQY | SEQ ID NO: 2529 |
| ASSLGTGTEAF | SEQ ID NO: 2530 |
| ASRDRGNTEAF | SEQ ID NO: 2531 |
| ASSLGHLNTEAF | SEQ ID NO: 2532 |
| ASSGTGGTDTQY | SEQ ID NO: 2533 |
| ASSWGETQY | SEQ ID NO: 2534 |
| ASSLAGYTEAF | SEQ ID NO: 2535 |
| ASSLTGRNTEAF | SEQ ID NO: 2536 |
| ASSLGTGSNQPQH | SEQ ID NO: 2537 |
| ASSPSADTQY | SEQ ID NO: 2538 |
| ASRASTDTQY | SEQ ID NO: 2539 |
| ASSLNSPLH | SEQ ID NO: 2540 |
| ASSLGGDEQY | SEQ ID NO: 2541 |
| ASSLGLADYNEQF | SEQ ID NO: 2542 |
| ASSDRNTEAF | SEQ ID NO: 2543 |
| ASSRGVNTEAF | SEQ ID NO: 2544 |
| ASSQLNTEAF | SEQ ID NO: 2545 |
| ASSLASQETQY | SEQ ID NO: 2546 |
| ASSFGGNTIY | SEQ ID NO: 2547 |
| ASSLTGDEQY | SEQ ID NO: 2548 |
| ASRDRGYEQY | SEQ ID NO: 2549 |
| ASSLPGGTEAF | SEQ ID NO: 2550 |
| ASSPQGGNTEAF | SEQ ID NO: 2551 |
| ASSLGTGGTDTQY | SEQ ID NO: 2552 |
| ASSGQPNTEAF | SEQ ID NO: 2553 |
| ASSSGQETQY | SEQ ID NO: 2554 |
| ASSLDQPQH | SEQ ID NO: 2555 |
| ASSGGYGYT | SEQ ID NO: 2556 |
| ASSPSGNEQF | SEQ ID NO: 2557 |
| ASSRGPNTEAF | SEQ ID NO: 2558 |
| ASSLRQSTDTQY | SEQ ID NO: 2559 |
| ASSLGQGYTEAF | SEQ ID NO: 2560 |
| ASSRDRGQETQY | SEQ ID NO: 2561 |
| ASSYGVNTEAF | SEQ ID NO: 2562 |
| ASSANTEAF | SEQ ID NO: 2563 |
| ASRRDSTDTQY | SEQ ID NO: 2564 |
| ASSISYEQY | SEQ ID NO: 2565 |
| ASSLGQDTEAF | SEQ ID NO: 2566 |
| ASSRGSSYEQY | SEQ ID NO: 2567 |
| ASSLGLETQY | SEQ ID NO: 2568 |
| ASSLRGPYEQY | SEQ ID NO: 2569 |
| ASSSQGTEAF | SEQ ID NO: 2570 |
| ASSLDGQPQH | SEQ ID NO: 2571 |
| ASSSGGQETQY | SEQ ID NO: 2572 |
| ASSPGTVYGYT | SEQ ID NO: 2573 |
| ASSTTYEQY | SEQ ID NO: 2574 |
| ASSLGRGSYEQY | SEQ ID NO: 2575 |
| ASSSGGGTDTQY | SEQ ID NO: 2576 |

TABLE I-continued

| Sequence | Sequence ID No |
|---|---|
| ASSRTNTEAF | SEQ ID NO: 2577 |
| SARGNTEAF | SEQ ID NO: 2578 |
| ASSQAGYEQY | SEQ ID NO: 2579 |
| ASSLGLAGNNEQF | SEQ ID NO: 2580 |
| ASSWGGTEAF | SEQ ID NO: 2581 |
| ASSLGANQPQH | SEQ ID NO: 2582 |
| ASSPGATNEKLF | SEQ ID NO: 2583 |
| ASSLSAYEQY | SEQ ID NO: 2584 |
| ASSPHYEQY | SEQ ID NO: 2585 |
| ASSPSGNQPQH | SEQ ID NO: 2586 |
| ASSLKGGTEAF | SEQ ID NO: 2587 |
| ASSPSGGSYNEQF | SEQ ID NO: 2588 |
| ASSPTRNTEAF | SEQ ID NO: 2589 |
| ASSPRGGNTEAF | SEQ ID NO: 2590 |
| ASSPGYTEAF | SEQ ID NO: 2591 |
| ASSRTDSNQPQH | SEQ ID NO: 2592 |
| ASSPQENTEAF | SEQ ID NO: 2593 |
| ASSFLGTEAF | SEQ ID NO: 2594 |
| ASSPRDSNQPQH | SEQ ID NO: 2595 |
| ASSQYQETQY | SEQ ID NO: 2596 |
| ASSLDWNTEAF | SEQ ID NO: 2597 |
| ASSLGGTSTDTQY | SEQ ID NO: 2598 |
| ASSLGLAETQY | SEQ ID NO: 2599 |
| ASSLNGNTEAF | SEQ ID NO: 2600 |
| ASSLDNSPLH | SEQ ID NO: 2601 |
| ASSPRGSSYNEQF | SEQ ID NO: 2602 |
| ASSLVRDTQY | SEQ ID NO: 2603 |
| ASSLVQGNTEAF | SEQ ID NO: 2604 |
| ASSPSNTEAF | SEQ ID NO: 2605 |
| SARTSGSYEQY | SEQ ID NO: 2606 |
| ASSLWNTEAF | SEQ ID NO: 2607 |
| ASSLAGVYNEQF | SEQ ID NO: 2608 |
| ASSYGGNEQF | SEQ ID NO: 2609 |
| ASSSTGGSYEQY | SEQ ID NO: 2610 |
| ASSLTGGEQY | SEQ ID NO: 2611 |
| ASSLGSGTDTQY | SEQ ID NO: 2612 |
| ASSLAGAETQY | SEQ ID NO: 2613 |
| ASSPRGSYNEQF | SEQ ID NO: 2614 |
| SARTGDTEAF | SEQ ID NO: 2615 |
| ASSLESSYNEQF | SEQ ID NO: 2616 |
| ASSRGRNTEAF | SEQ ID NO: 2617 |
| ASSPGLAGADTQY | SEQ ID NO: 2618 |
| ASRTGSYEQY | SEQ ID NO: 2619 |
| ASSYSGGTDTQY | SEQ ID NO: 2620 |
| ASSSVTDTQY | SEQ ID NO: 2621 |
| ASSPLGNTEAF | SEQ ID NO: 2622 |
| ASSFQNTEAF | SEQ ID NO: 2623 |
| ASSPRGYNEQF | SEQ ID NO: 2624 |
| ASSLTASTDTQY | SEQ ID NO: 2625 |
| ASSPPGGYEQY | SEQ ID NO: 2626 |
| ASRANTEAF | SEQ ID NO: 2627 |
| ASSLEGRNTEAF | SEQ ID NO: 2628 |
| ASSFLGNTEAF | SEQ ID NO: 2629 |
| ASSLDPNQPQH | SEQ ID NO: 2630 |
| ASSLGSPLH | SEQ ID NO: 2631 |
| ASSLEGSGNTIY | SEQ ID NO: 2632 |
| ASSYRGETQY | SEQ ID NO: 2633 |
| ASSFSGSYNEQF | SEQ ID NO: 2634 |
| ASSLYSTDTQY | SEQ ID NO: 2635 |
| ASSLGNETQY | SEQ ID NO: 2636 |
| ASSPGYSNQPQH | SEQ ID NO: 2637 |
| ASSLSSYNSPLH | SEQ ID NO: 2638 |
| ASSLNRDTEAF | SEQ ID NO: 2639 |
| ASSLQGPDTQY | SEQ ID NO: 2640 |
| ASSPNYNEQF | SEQ ID NO: 2641 |
| ASSLDTYNEQF | SEQ ID NO: 2642 |
| ASSRDSSGNTIY | SEQ ID NO: 2643 |
| ASSQGQQETQY | SEQ ID NO: 2644 |
| ASSLGGGPYEQY | SEQ ID NO: 2645 |
| ASSFRRNTEAF | SEQ ID NO: 2646 |
| ASSYRYEQY | SEQ ID NO: 2647 |
| ASSQGDTEAF | SEQ ID NO: 2648 |
| ASSLGRVNTEAF | SEQ ID NO: 2649 |
| ASSLVGDQPQH | SEQ ID NO: 2650 |
| ASSRDRGYGYT | SEQ ID NO: 2651 |
| ASSLGGATEAF | SEQ ID NO: 2652 |
| ASSLGGAQETQY | SEQ ID NO: 2653 |
| ASSLTTYEQY | SEQ ID NO: 2654 |

TABLE I-continued

| Sequence | Sequence ID No |
|---|---|
| ASSQGTGELF | SEQ ID NO: 2655 |
| ASSLLDEQF | SEQ ID NO: 2656 |
| ASSLQGGYGYT | SEQ ID NO: 2657 |
| ASSLGQGGETQY | SEQ ID NO: 2658 |
| ASTRNTEAF | SEQ ID NO: 2659 |
| ASSSGGYNEQF | SEQ ID NO: 2660 |
| ASSLGLAAYEQY | SEQ ID NO: 2661 |
| ASSLGAANTEAF | SEQ ID NO: 2662 |
| ASSLGSSGANVLT | SEQ ID NO: 2663 |
| ASSPGQDYGYT | SEQ ID NO: 2664 |
| ASSQDLETQY | SEQ ID NO: 2665 |
| ASSSRGNQPQH | SEQ ID NO: 2666 |
| ASSYSTGELF | SEQ ID NO: 2667 |
| ASSFSGSNQPQH | SEQ ID NO: 2668 |
| ASSLLTGELF | SEQ ID NO: 2669 |
| ASSLVSNTEAF | SEQ ID NO: 2670 |
| ASSRSDTQY | SEQ ID NO: 2671 |
| ASSLGSEQF | SEQ ID NO: 2672 |
| SARDRDTEAF | SEQ ID NO: 2673 |
| ASSRDRDYGYT | SEQ ID NO: 2674 |
| ASSLAGSDTQY | SEQ ID NO: 2675 |
| ASSGADTQY | SEQ ID NO: 2676 |
| ASSLAGGSNQPQH | SEQ ID NO: 2677 |
| ASSQTTDTQY | SEQ ID NO: 2678 |
| ASSLGQGRTEAF | SEQ ID NO: 2679 |
| ASSPASTDTQY | SEQ ID NO: 2680 |
| ASSPGLAADTQY | SEQ ID NO: 2681 |
| ASSQVETQY | SEQ ID NO: 2682 |
| ASSLPDTQY | SEQ ID NO: 2683 |
| ASSLVEETQY | SEQ ID NO: 2684 |
| ASSPGENTEAF | SEQ ID NO: 2685 |
| ASSTTVNTEAF | SEQ ID NO: 2686 |
| ASSLRGGYEQY | SEQ ID NO: 2687 |
| ASSIGGNTEAF | SEQ ID NO: 2688 |
| ASSLGAGNTIY | SEQ ID NO: 2689 |
| ASRDSSYNEQF | SEQ ID NO: 2690 |
| ASSSGTGYGYT | SEQ ID NO: 2691 |
| ASSGTGGTEAF | SEQ ID NO: 2692 |
| ASSSDRNQPQH | SEQ ID NO: 2693 |
| ASSRQGYGYT | SEQ ID NO: 2694 |
| ASSRNSNQPQH | SEQ ID NO: 2695 |
| ASSLTVNQPQH | SEQ ID NO: 2696 |
| ASRGTGNTEAF | SEQ ID NO: 2697 |
| ASSYLNTEAF | SEQ ID NO: 2698 |
| ASSLLAGSYEQY | SEQ ID NO: 2699 |
| ASSENSNQPQH | SEQ ID NO: 2700 |
| ASSRSGANVLT | SEQ ID NO: 2701 |
| ASSLAGDEQY | SEQ ID NO: 2702 |
| ASSYNTGELF | SEQ ID NO: 2703 |
| ASSFTTDTQY | SEQ ID NO: 2704 |
| ASSLAGVETQY | SEQ ID NO: 2705 |
| ASSSSGSYNEQF | SEQ ID NO: 2706 |
| ASRGGSYEQY | SEQ ID NO: 2707 |
| ASSLGDTDTQY | SEQ ID NO: 2708 |
| ASSPQGDQPQH | SEQ ID NO: 2709 |
| ASSFGGEQY | SEQ ID NO: 2710 |
| ASSLGQDYEQY | SEQ ID NO: 2711 |
| ASSRRTDTQY | SEQ ID NO: 2712 |
| ASSYRGYEQY | SEQ ID NO: 2713 |
| ASSPPGTEAF | SEQ ID NO: 2714 |
| ASSPGRLNTEAF | SEQ ID NO: 2715 |
| ASSLGDSYNEQF | SEQ ID NO: 2716 |
| ASSFRGDTEAF | SEQ ID NO: 2717 |
| ASSLDGMNTEAF | SEQ ID NO: 2718 |
| ASSQGPNQPQH | SEQ ID NO: 2719 |
| ASSRGGSYEQY | SEQ ID NO: 2720 |
| ASSLGLSSYNEQF | SEQ ID NO: 2721 |
| ASSLSGNTGELF | SEQ ID NO: 2722 |
| ASSPSGQETQY | SEQ ID NO: 2723 |
| ASSLGTGSTDTQY | SEQ ID NO: 2724 |
| ASSFVNTEAF | SEQ ID NO: 2725 |
| ASSPTGETQY | SEQ ID NO: 2726 |
| SVGGNTEAF | SEQ ID NO: 2727 |
| ASSLGGTGNTIY | SEQ ID NO: 2728 |
| ASSPGTGGTDTQY | SEQ ID NO: 2729 |
| ASSEGGYEQY | SEQ ID NO: 2730 |
| ASSPRTEAF | SEQ ID NO: 2731 |
| ASSPTGAYEQY | SEQ ID NO: 2732 |

TABLE I-continued

| Sequence | Sequence ID No |
|---|---|
| ASSLGTGYNEQF | SEQ ID NO: 2733 |
| ASSQDRDTQY | SEQ ID NO: 2734 |
| ASSEGRNTEAF | SEQ ID NO: 2735 |
| ASSPPADTQY | SEQ ID NO: 2736 |
| ASSPGTVNQPQH | SEQ ID NO: 2737 |
| ASSLARDTEAF | SEQ ID NO: 2738 |
| ASSSTGGNTEAF | SEQ ID NO: 2739 |
| ASSGGNEQF | SEQ ID NO: 2740 |
| ASSLDGTYEQY | SEQ ID NO: 2741 |
| ASSLGAGNQPQH | SEQ ID NO: 2742 |
| ASSLVSNEQF | SEQ ID NO: 2743 |
| ASSLGLAGQETQY | SEQ ID NO: 2744 |
| ASSLGPGNTEAF | SEQ ID NO: 2745 |
| ASSRTLNTEAF | SEQ ID NO: 2746 |
| ASSQDSYGYT | SEQ ID NO: 2747 |
| ASSLRGGETQY | SEQ ID NO: 2748 |
| ASSSGQGNYGYT | SEQ ID NO: 2749 |
| ASSSSMNTEAF | SEQ ID NO: 2750 |
| ASSLDRDYEQY | SEQ ID NO: 2751 |
| ASSQGQGSYEQY | SEQ ID NO: 2752 |
| ASSGTGDQPQH | SEQ ID NO: 2753 |
| ASSLDSDTQY | SEQ ID NO: 2754 |
| ASSRDTYEQY | SEQ ID NO: 2755 |
| ASSFTGTDTQY | SEQ ID NO: 2756 |
| ASSLDGSSYEQY | SEQ ID NO: 2757 |
| ASRTNTEAF | SEQ ID NO: 2758 |
| ASSRDSSNQPQH | SEQ ID NO: 2759 |
| ASSRLAGTDTQY | SEQ ID NO: 2760 |
| ASSPGTNYGYT | SEQ ID NO: 2761 |
| ASSPTSYNEQF | SEQ ID NO: 2762 |
| ASSRQGSTDTQY | SEQ ID NO: 2763 |
| ASSEADTQY | SEQ ID NO: 2764 |
| ASSLAGTNTEAF | SEQ ID NO: 2765 |
| ASSFRADTQY | SEQ ID NO: 2766 |
| ASSGNEQF | SEQ ID NO: 2767 |
| ASSLAAYEQY | SEQ ID NO: 2768 |
| ASSLQGGETQY | SEQ ID NO: 2769 |
| ASSLSPNQPQH | SEQ ID NO: 2770 |
| ASSRLAGGYNEQF | SEQ ID NO: 2771 |
| ASSPTGGSYNEQF | SEQ ID NO: 2772 |
| ASSPGTVSYEQY | SEQ ID NO: 2773 |
| ASSLASSTDTQY | SEQ ID NO: 2774 |
| ASSPRQETQY | SEQ ID NO: 2775 |
| ASSYQGNTEAF | SEQ ID NO: 2776 |
| ASSPDRSSYNEQF | SEQ ID NO: 2777 |
| ASSPDRAYGYT | SEQ ID NO: 2778 |
| ASSLGLTYEQY | SEQ ID NO: 2779 |
| ASSLGTSYNEQF | SEQ ID NO: 2780 |
| ASSSSSGNTIY | SEQ ID NO: 2781 |
| ASSLERTDTQY | SEQ ID NO: 2782 |
| ASSPRGGTDTQY | SEQ ID NO: 2783 |
| ASSPRTGGYEQY | SEQ ID NO: 2784 |
| ASSFLGTDTQY | SEQ ID NO: 2785 |
| ASSVGVNTEAF | SEQ ID NO: 2786 |
| ASSDRENTEAF | SEQ ID NO: 2787 |
| ASSLDGLNTEAF | SEQ ID NO: 2788 |
| ASSPRDRGYEQY | SEQ ID NO: 2789 |
| ASSFGTGNQPQH | SEQ ID NO: 2790 |
| ASSRTGLNTEAF | SEQ ID NO: 2791 |
| ASSLARQETQY | SEQ ID NO: 2792 |
| ASSLQPNTEAF | SEQ ID NO: 2793 |
| ASSPGQGSNQPQH | SEQ ID NO: 2794 |
| ASRRGTEAF | SEQ ID NO: 2795 |
| ASSPRQGGTEAF | SEQ ID NO: 2796 |
| ASSPGQGDQPQH | SEQ ID NO: 2797 |
| ASSQEGNQPQH | SEQ ID NO: 2798 |
| ASSFGQGSYEQY | SEQ ID NO: 2799 |
| ASSLGQGPDTQY | SEQ ID NO: 2800 |
| ASSFGTSTDTQY | SEQ ID NO: 2801 |
| ASSPGPNYGYT | SEQ ID NO: 2802 |
| ASSPGRYEQY | SEQ ID NO: 2803 |
| ASSLDLYEQY | SEQ ID NO: 2804 |
| ASSLAGGRTDTQY | SEQ ID NO: 2805 |
| ASSEGGTDTQY | SEQ ID NO: 2806 |
| ASSLEGTQY | SEQ ID NO: 2807 |
| ASSSGNTGELF | SEQ ID NO: 2808 |
| ASSLGGDGYT | SEQ ID NO: 2809 |
| ASSFGQSYEQY | SEQ ID NO: 2810 |

TABLE I-continued

| Sequence | Sequence ID No |
|---|---|
| ASSFRGDTQY | SEQ ID NO: 2811 |
| ASSFTGNQPQH | SEQ ID NO: 2812 |
| ASSRTSGQETQY | SEQ ID NO: 2813 |
| ASSLTGDGYT | SEQ ID NO: 2814 |
| ASSLHYEQY | SEQ ID NO: 2815 |
| ASSLGDGYT | SEQ ID NO: 2816 |
| ASRGGNTEAF | SEQ ID NO: 2817 |
| ASSLGREAF | SEQ ID NO: 2818 |
| ASSEDSNQPQH | SEQ ID NO: 2819 |
| ASSLGLAGSYEQY | SEQ ID NO: 2820 |
| ASRTSGSYEQY | SEQ ID NO: 2821 |
| ASSLRASTDTQY | SEQ ID NO: 2822 |
| ASSLDPYEQY | SEQ ID NO: 2823 |
| ASSLERNQPQH | SEQ ID NO: 2824 |
| ASSLVSSYNEQF | SEQ ID NO: 2825 |
| ASSGGLNTEAF | SEQ ID NO: 2826 |
| ASSETYEQY | SEQ ID NO: 2827 |
| SARRGNTEAF | SEQ ID NO: 2828 |
| ASSLGTSGSTDTQY | SEQ ID NO: 2829 |
| ASSLSGEETQY | SEQ ID NO: 2830 |
| ASSSTLNTEAF | SEQ ID NO: 2831 |
| ASSFAGTDTQY | SEQ ID NO: 2832 |
| ASSPTSGQETQY | SEQ ID NO: 2833 |
| ASSLSQPQH | SEQ ID NO: 2834 |
| ASGYEQY | SEQ ID NO: 2835 |
| ASSSGQPQH | SEQ ID NO: 2836 |
| ASSLRGSGANVLT | SEQ ID NO: 2837 |
| ASGSYNEQF | SEQ ID NO: 2838 |
| ASSLPGQETQY | SEQ ID NO: 2839 |
| ASSSNEQF | SEQ ID NO: 2840 |
| ASRGDSYEQY | SEQ ID NO: 2841 |
| ASSLQGTNTEAF | SEQ ID NO: 2842 |
| ASSLTGPDTQY | SEQ ID NO: 2843 |
| ASSLVAGNTEAF | SEQ ID NO: 2844 |
| ASSLQSTDTQY | SEQ ID NO: 2845 |
| ASSLISTDTQY | SEQ ID NO: 2846 |
| ASSYTYEQY | SEQ ID NO: 2847 |
| ASSAGLNTEAF | SEQ ID NO: 2848 |
| ASSATVNTEAF | SEQ ID NO: 2849 |
| ASSLLGGNQPQH | SEQ ID NO: 2850 |
| ASSLGRANTEAF | SEQ ID NO: 2851 |
| ASSFSGGTEAF | SEQ ID NO: 2852 |
| ASSLDRATDTQY | SEQ ID NO: 2853 |
| ASSRGYGYT | SEQ ID NO: 2854 |
| ASSIGDTQY | SEQ ID NO: 2855 |
| ASSLGPGNTIY | SEQ ID NO: 2856 |
| ASSLWGNQPQH | SEQ ID NO: 2857 |
| ASSWGNEQF | SEQ ID NO: 2858 |
| ASSLGGASYEQY | SEQ ID NO: 2859 |
| ASSLTASYEQY | SEQ ID NO: 2860 |
| ASSPSGGYNEQF | SEQ ID NO: 2861 |
| ASSFPGTEAF | SEQ ID NO: 2862 |
| ASSLGANTGELF | SEQ ID NO: 2863 |
| ASSLVAGTDTQY | SEQ ID NO: 2864 |
| ASSRENTEAF | SEQ ID NO: 2865 |
| ASSPTNTGELF | SEQ ID NO: 2866 |
| ASSLTTEAF | SEQ ID NO: 2867 |
| ASSLSGVNTEAF | SEQ ID NO: 2868 |
| ASSPGLTDTQY | SEQ ID NO: 2869 |
| ASSFGQGYGYT | SEQ ID NO: 2870 |
| ASSPRTGGTEAF | SEQ ID NO: 2871 |
| ASSSGPSYEQY | SEQ ID NO: 2872 |
| ASSYSGTDTQY | SEQ ID NO: 2873 |
| ASSSRSTDTQY | SEQ ID NO: 2874 |
| ASSLRGSTEAF | SEQ ID NO: 2875 |
| ASSLTSGYEQY | SEQ ID NO: 2876 |
| ASSLVGGGTEAF | SEQ ID NO: 2877 |
| ASSWGDTQY | SEQ ID NO: 2878 |
| ASSWDSTDTQY | SEQ ID NO: 2879 |
| ASSLSGTYNEQF | SEQ ID NO: 2880 |
| ASSPSVNTEAF | SEQ ID NO: 2881 |
| ASSLGTGSYNEQF | SEQ ID NO: 2882 |
| ASSFGTNTEAF | SEQ ID NO: 2883 |
| ASSSRTGNTEAF | SEQ ID NO: 2884 |
| ASRGDSNQPQH | SEQ ID NO: 2885 |
| ASSQVSYEQY | SEQ ID NO: 2886 |
| ASSGGGTEAF | SEQ ID NO: 2887 |
| ASSLEGSTEAF | SEQ ID NO: 2888 |

TABLE I-continued

| Sequence | Sequence ID No |
|---|---|
| ASSLSGGNEQF | SEQ ID NO: 2889 |
| ASSFQGSYEQY | SEQ ID NO: 2890 |
| ASSLQSNQPQH | SEQ ID NO: 2891 |
| ASSLAGPNTEAF | SEQ ID NO: 2892 |
| ASSLVDQPQH | SEQ ID NO: 2893 |
| ASSSSLNTEAF | SEQ ID NO: 2894 |
| ASSWTSGTDTQY | SEQ ID NO: 2895 |
| ASSSDGNTEAF | SEQ ID NO: 2896 |
| ASSFSMNTEAF | SEQ ID NO: 2897 |
| ASSLDRAGNTIY | SEQ ID NO: 2898 |
| ASSLSSSTDTQY | SEQ ID NO: 2899 |
| ASSLGDSPLH | SEQ ID NO: 2900 |
| ASSFRSNQPQH | SEQ ID NO: 2901 |
| ASSEGGNTEAF | SEQ ID NO: 2902 |
| ASSLERGTEAF | SEQ ID NO: 2903 |
| ASSLSRNEQF | SEQ ID NO: 2904 |
| ASSRQGSTEAF | SEQ ID NO: 2905 |
| ASSFRTEAF | SEQ ID NO: 2906 |
| ASSLFSNQPQH | SEQ ID NO: 2907 |
| ASSPDTGELF | SEQ ID NO: 2908 |
| ASSSRSYEQY | SEQ ID NO: 2909 |
| ASSSTGGYGYT | SEQ ID NO: 2910 |
| SARTGGTEAF | SEQ ID NO: 2911 |
| ASSRDSSTDTQY | SEQ ID NO: 2912 |
| ASSLGQENTEAF | SEQ ID NO: 2913 |
| ASSPGGPYEQY | SEQ ID NO: 2914 |
| ASSPTNTEAF | SEQ ID NO: 2915 |
| ASSLEGGYEQY | SEQ ID NO: 2916 |
| ASSLGGNSNQPQH | SEQ ID NO: 2917 |
| ASRTTDTQY | SEQ ID NO: 2918 |
| ASRSSGANVLT | SEQ ID NO: 2919 |
| ASSFGYGYT | SEQ ID NO: 2920 |
| ASSDRVNTEAF | SEQ ID NO: 2921 |
| ASSPGGGQPQH | SEQ ID NO: 2922 |
| ASSEGQPQH | SEQ ID NO: 2923 |
| ASSWTGGTEAF | SEQ ID NO: 2924 |
| ASSRTGAYEQY | SEQ ID NO: 2925 |
| ASSYSSSYEQY | SEQ ID NO: 2926 |
| ASSPGTGVYEQY | SEQ ID NO: 2927 |
| ASSLGPSSYNEQF | SEQ ID NO: 2928 |
| ASSRGGETQY | SEQ ID NO: 2929 |
| ASSLEGEQY | SEQ ID NO: 2930 |
| ASSLSRGNTEAF | SEQ ID NO: 2931 |
| ASSDRGYGYT | SEQ ID NO: 2932 |
| ASSQGRGTEAF | SEQ ID NO: 2933 |
| SARGGNQPQH | SEQ ID NO: 2934 |
| ASSLGIQETQY | SEQ ID NO: 2935 |
| ASSGDTQY | SEQ ID NO: 2936 |
| ASSLADEQF | SEQ ID NO: 2937 |
| ASRGSSYEQY | SEQ ID NO: 2938 |
| ASSLRQGSYEQY | SEQ ID NO: 2939 |
| ASSLAGDEQF | SEQ ID NO: 2940 |
| ASSGLAGGPDTQY | SEQ ID NO: 2941 |
| ASSFRGSTDTQY | SEQ ID NO: 2942 |
| ASSPDTYEQY | SEQ ID NO: 2943 |
| ASSLAGTSTDTQY | SEQ ID NO: 2944 |
| ASSFRGSGNTIY | SEQ ID NO: 2945 |
| ASSSHNEQF | SEQ ID NO: 2946 |
| ASSLTVSYEQY | SEQ ID NO: 2947 |
| ASRGDTQY | SEQ ID NO: 2948 |
| SARGDSNQPQH | SEQ ID NO: 2949 |
| ASSWTGNQPQH | SEQ ID NO: 2950 |
| ASSLGVNYGYT | SEQ ID NO: 2951 |
| ASSAGGTEAF | SEQ ID NO: 2952 |
| ASRGNEQF | SEQ ID NO: 2953 |
| ASSQGRETQY | SEQ ID NO: 2954 |
| ASSPGDQPQH | SEQ ID NO: 2955 |
| ASSLSRGTDTQY | SEQ ID NO: 2956 |
| ASSEGGTEAF | SEQ ID NO: 2957 |
| ASSSGLATDTQY | SEQ ID NO: 2958 |
| ASSLTGVTEAF | SEQ ID NO: 2959 |
| ASSSPGQYEQY | SEQ ID NO: 2960 |
| ASSQVGGTEAF | SEQ ID NO: 2961 |
| ASSDGNQPQH | SEQ ID NO: 2962 |
| ASSLVGGSTDTQY | SEQ ID NO: 2963 |
| ASSSGDQPQH | SEQ ID NO: 2964 |
| ASSSRNEQF | SEQ ID NO: 2965 |
| ASRGTGELF | SEQ ID NO: 2966 |

TABLE I-continued

| Sequence | Sequence ID No |
|---|---|
| ASSFDSYNEQF | SEQ ID NO: 2967 |
| ASSGQVNTEAF | SEQ ID NO: 2968 |
| ASSSSNEQF | SEQ ID NO: 2969 |
| ASSFGGYNEQF | SEQ ID NO: 2970 |
| ASSLGGQGYEQY | SEQ ID NO: 2971 |
| ASSLGGYTDTQY | SEQ ID NO: 2972 |
| ASSLPGNTIY | SEQ ID NO: 2973 |
| ASSDSYNEQF | SEQ ID NO: 2974 |
| ASSIGNQPQH | SEQ ID NO: 2975 |
| ASSLGQGATEAF | SEQ ID NO: 2976 |
| ASSPGTGDYEQY | SEQ ID NO: 2977 |
| ASRDSTDTQY | SEQ ID NO: 2978 |
| ASSFGTAYEQY | SEQ ID NO: 2979 |
| ASSPSRNTEAF | SEQ ID NO: 2980 |
| ASSPRDRAYEQY | SEQ ID NO: 2981 |
| ASSLDYTDTQY | SEQ ID NO: 2982 |
| ASSRTGMNTEAF | SEQ ID NO: 2983 |
| ASSPSGGTEAF | SEQ ID NO: 2984 |
| ASSPSGYNEQF | SEQ ID NO: 2985 |
| ASSLGLGETQY | SEQ ID NO: 2986 |
| ASSPDRQETQY | SEQ ID NO: 2987 |
| ASSSRYNEQF | SEQ ID NO: 2988 |
| ASSFRGSNQPQH | SEQ ID NO: 2989 |
| ASSQDRNYGYT | SEQ ID NO: 2990 |
| ASSLALTDTQY | SEQ ID NO: 2991 |
| ASSLREETQY | SEQ ID NO: 2992 |
| ASSPRYNEQF | SEQ ID NO: 2993 |
| ASSQDRSYEQY | SEQ ID NO: 2994 |
| ASSGGYNEQF | SEQ ID NO: 2995 |
| ASSPDMNTEAF | SEQ ID NO: 2996 |
| ASSLTGTGELF | SEQ ID NO: 2997 |
| ASSLIETQY | SEQ ID NO: 2998 |
| ASSFLGQPQH | SEQ ID NO: 2999 |
| ASSSDTEAF | SEQ ID NO: 3000 |
| ASSLARGNTEAF | SEQ ID NO: 3001 |
| ASSTGGNQPQH | SEQ ID NO: 3002 |
| ASSFSTGELF | SEQ ID NO: 3003 |
| ASSQDRYNEQF | SEQ ID NO: 3004 |
| ASSLGANEQF | SEQ ID NO: 3005 |
| ASSPGTVYEQY | SEQ ID NO: 3006 |
| ASSQYSNQPQH | SEQ ID NO: 3007 |
| ASSYRDTQY | SEQ ID NO: 3008 |
| ASRSNTEAF | SEQ ID NO: 3009 |
| ASRQGLNTEAF | SEQ ID NO: 3010 |
| ASSLLAGGYEQY | SEQ ID NO: 3011 |
| ASRTSGSTDTQY | SEQ ID NO: 3012 |
| ASSRQGDQPQH | SEQ ID NO: 3013 |
| ASSLGGTNEKLF | SEQ ID NO: 3014 |
| ASSPQGQETQY | SEQ ID NO: 3015 |
| ASSPTGTEAF | SEQ ID NO: 3016 |
| ASSLGRGQPQH | SEQ ID NO: 3017 |
| ASSLGLMNTEAF | SEQ ID NO: 3018 |
| ASSQAGTDTQY | SEQ ID NO: 3019 |
| ASSLQSSYNEQF | SEQ ID NO: 3020 |
| ASSVTVNTEAF | SEQ ID NO: 3021 |
| ASSLGTAYNEQF | SEQ ID NO: 3022 |
| ASSPGTGELF | SEQ ID NO: 3023 |
| ASSFGEKLF | SEQ ID NO: 3024 |
| ASSLTRTDTQY | SEQ ID NO: 3025 |
| ASSLAGGGYEQY | SEQ ID NO: 3026 |
| ASSLWGTDTQY | SEQ ID NO: 3027 |
| ASSSTGSGNTIY | SEQ ID NO: 3028 |
| ASSYGGSNQPQH | SEQ ID NO: 3029 |
| ASSRDGSYEQY | SEQ ID NO: 3030 |
| ASSLGGGNQPQH | SEQ ID NO: 3031 |
| ASGTDTQY | SEQ ID NO: 3032 |
| ASSRGQLNTEAF | SEQ ID NO: 3033 |
| ASSQGAEAF | SEQ ID NO: 3034 |
| ASRQETQY | SEQ ID NO: 3035 |
| ASSRPQETQY | SEQ ID NO: 3036 |
| ASSLVRGNTEAF | SEQ ID NO: 3037 |
| ASSGQGSNQPQH | SEQ ID NO: 3038 |
| ASSLTVQETQY | SEQ ID NO: 3039 |
| ASSSQGGNQPQH | SEQ ID NO: 3040 |
| ASSRQGSYNEQF | SEQ ID NO: 3041 |
| ASSSDSSYEQY | SEQ ID NO: 3042 |
| ASSPGRDTQY | SEQ ID NO: 3043 |
| ASSYGSTDTQY | SEQ ID NO: 3044 |

TABLE I-continued

| Sequence | Sequence ID No |
|---|---|
| ASSYNEQF | SEQ ID NO: 3045 |
| ASSQEGGTEAF | SEQ ID NO: 3046 |
| ASSRGQGNPQH | SEQ ID NO: 3047 |
| ASSLQYEQY | SEQ ID NO: 3048 |
| ASSYLDTQY | SEQ ID NO: 3049 |
| ASSPQGYNEQF | SEQ ID NO: 3050 |
| ASSSGTSGYEQY | SEQ ID NO: 3051 |
| ASSFGGYGYT | SEQ ID NO: 3052 |
| ASSPRGLNTEAF | SEQ ID NO: 3053 |
| ASSGTENTEAF | SEQ ID NO: 3054 |
| ASSQDRGETQY | SEQ ID NO: 3055 |
| ASSQVQETQY | SEQ ID NO: 3056 |
| ASSLGSMNTEAF | SEQ ID NO: 3057 |
| ASSLLRETQY | SEQ ID NO: 3058 |
| ASSLADNEQF | SEQ ID NO: 3059 |
| ASSLQGSYGYT | SEQ ID NO: 3060 |
| ASSLLTEAF | SEQ ID NO: 3061 |
| ASSLAGASYEQY | SEQ ID NO: 3062 |
| ASSPDREETQY | SEQ ID NO: 3063 |
| ASSPGQSSYEQY | SEQ ID NO: 3064 |
| ASSLRGEAF | SEQ ID NO: 3065 |
| ASSLTSGAYNEQF | SEQ ID NO: 3066 |
| ASSLVGDEQF | SEQ ID NO: 3067 |
| ASSFGSGNTIY | SEQ ID NO: 3068 |
| ASSWGQGNTEAF | SEQ ID NO: 3069 |
| ASSPRQGAYEQY | SEQ ID NO: 3070 |
| ASSPYYEQY | SEQ ID NO: 3071 |
| ASSLVASTDTQY | SEQ ID NO: 3072 |
| ASSVGNQPQH | SEQ ID NO: 3073 |
| ASSLNNSPLH | SEQ ID NO: 3074 |
| ASSISGSSYNEQF | SEQ ID NO: 3075 |
| ASSPGTGSNQPQH | SEQ ID NO: 3076 |
| ASSLGLAGTYEQY | SEQ ID NO: 3077 |
| ASSLAVSYEQY | SEQ ID NO: 3078 |
| ASSPRQGTDTQY | SEQ ID NO: 3079 |
| ASSYRGNEQF | SEQ ID NO: 3080 |
| ASSFSGDTQY | SEQ ID NO: 3081 |
| ASSPGRTDTQY | SEQ ID NO: 3082 |
| ASSLDRDNEQF | SEQ ID NO: 3083 |
| ASSPGGNTIY | SEQ ID NO: 3084 |
| ASSENTGELF | SEQ ID NO: 3085 |
| ASSLLAGAYEQY | SEQ ID NO: 3086 |
| ASSSSGSYEQY | SEQ ID NO: 3087 |
| ASSLPGTEAF | SEQ ID NO: 3088 |
| ASSLNSQETQY | SEQ ID NO: 3089 |
| ASSPRGSNQPQH | SEQ ID NO: 3090 |
| ASSLIGNTEAF | SEQ ID NO: 3091 |
| ASSSLSTDTQY | SEQ ID NO: 3092 |
| ASSLRTGQETQY | SEQ ID NO: 3093 |
| ASSQGGSYNEQF | SEQ ID NO: 3094 |
| ASSLGQGGEKLF | SEQ ID NO: 3095 |
| ASRPSTDTQY | SEQ ID NO: 3096 |
| ASSESNQPQH | SEQ ID NO: 3097 |
| ASSPTMNTEAF | SEQ ID NO: 3098 |
| ASSSRVNTEAF | SEQ ID NO: 3099 |
| ASSRTGTYEQY | SEQ ID NO: 3100 |
| ASSEQGNQPQH | SEQ ID NO: 3101 |
| ASSLYSYEQY | SEQ ID NO: 3102 |
| ASSLAGGGNEQF | SEQ ID NO: 3103 |
| ASSLLAGADTQY | SEQ ID NO: 3104 |
| ASSQGTGNQPQH | SEQ ID NO: 3105 |
| ASSETGNTEAF | SEQ ID NO: 3106 |
| ASSPLAGAYNEQF | SEQ ID NO: 3107 |
| ASSEGGNQPQH | SEQ ID NO: 3108 |
| ASSSRGETQY | SEQ ID NO: 3109 |
| ASSYSGGSYEQY | SEQ ID NO: 3110 |
| ASSLENEQF | SEQ ID NO: 3111 |
| ASSFRQNTEAF | SEQ ID NO: 3112 |
| ASSLRGTYEQY | SEQ ID NO: 3113 |
| ASSLAGTTDTQY | SEQ ID NO: 3114 |
| ASSPGTSYNEQF | SEQ ID NO: 3115 |
| ASSLDRNTGELF | SEQ ID NO: 3116 |
| ASSFGGDTEAF | SEQ ID NO: 3117 |
| ASSSGQSTDTQY | SEQ ID NO: 3118 |
| ASSLADQPQH | SEQ ID NO: 3119 |
| ASSLTSGSSYEQY | SEQ ID NO: 3120 |
| ASSLHTDTQY | SEQ ID NO: 3121 |
| ASSQALNTEAF | SEQ ID NO: 3122 |

TABLE I-continued

| Sequence | Sequence ID No |
|---|---|
| ASSFNEQF | SEQ ID NO: 3123 |
| ASSLVAGGYNEQF | SEQ ID NO: 3124 |
| ASSAGQNTEAF | SEQ ID NO: 3125 |
| ASSLGPLNTEAF | SEQ ID NO: 3126 |
| ASSSTGYNEQF | SEQ ID NO: 3127 |
| ASSWGSNQPQH | SEQ ID NO: 3128 |
| ASSLAVTDTQY | SEQ ID NO: 3129 |
| ASSQGQLNTEAF | SEQ ID NO: 3130 |
| ASSQVRETQY | SEQ ID NO: 3131 |
| ASSSGLSYEQY | SEQ ID NO: 3132 |
| ASSPENTEAF | SEQ ID NO: 3133 |
| ASSLDSTYEQY | SEQ ID NO: 3134 |
| ASSSLYNEQF | SEQ ID NO: 3135 |
| ASSPQDTQY | SEQ ID NO: 3136 |
| ASSPGLEETQY | SEQ ID NO: 3137 |
| ASSRQGNEQF | SEQ ID NO: 3138 |
| ASSSPNTEAF | SEQ ID NO: 3139 |
| ASSLGGYQPQH | SEQ ID NO: 3140 |
| ASSLALQETQY | SEQ ID NO: 3141 |
| ASSLSPTDTQY | SEQ ID NO: 3142 |
| ASSPPGGNQPQH | SEQ ID NO: 3143 |
| ASRGSYNEQF | SEQ ID NO: 3144 |
| ASSRDSGNTIY | SEQ ID NO: 3145 |
| ASSDSYGYT | SEQ ID NO: 3146 |
| SASGSSYNEQF | SEQ ID NO: 3147 |
| ASSLINQPQH | SEQ ID NO: 3148 |
| ASSSGGSSYNEQF | SEQ ID NO: 3149 |
| ASSPLSYEQY | SEQ ID NO: 3150 |
| ASSLTDNQPQH | SEQ ID NO: 3151 |
| ASSLGGLETQY | SEQ ID NO: 3152 |
| ASSPVTDTQY | SEQ ID NO: 3153 |
| ASSLGLSNQPQH | SEQ ID NO: 3154 |
| SASRETQY | SEQ ID NO: 3155 |
| ASSPGLAAYNEQF | SEQ ID NO: 3156 |
| ASSRGGSNQPQH | SEQ ID NO: 3157 |
| ASSPRTGTDTQY | SEQ ID NO: 3158 |
| ASSSQGNYGYT | SEQ ID NO: 3159 |
| ASSPRGGETQY | SEQ ID NO: 3160 |
| ASSQGGSTDTQY | SEQ ID NO: 3161 |
| ASSLAGQNTEAF | SEQ ID NO: 3162 |
| ASRDRGNQPQH | SEQ ID NO: 3163 |
| ASSDRLNTEAF | SEQ ID NO: 3164 |
| ASSLDRGDTQY | SEQ ID NO: 3165 |
| ASSLSTNTEAF | SEQ ID NO: 3166 |
| ASSLNRGTEAF | SEQ ID NO: 3167 |
| ASSLGGYQETQY | SEQ ID NO: 3168 |
| ASSLAGAGNTIY | SEQ ID NO: 3169 |
| ASSLRGDEQF | SEQ ID NO: 3170 |
| ASSFGPDTQY | SEQ ID NO: 3171 |
| ASRRDTEAF | SEQ ID NO: 3172 |
| ASSYSQETQY | SEQ ID NO: 3173 |
| ASSMNTEAF | SEQ ID NO: 3174 |
| ASSLAGNNEQF | SEQ ID NO: 3175 |
| ASSFSGETQY | SEQ ID NO: 3176 |
| ASSLGQYEQY | SEQ ID NO: 3177 |
| ASSLGLAKNIQY | SEQ ID NO: 3178 |
| ASSYADTQY | SEQ ID NO: 3179 |
| ASSYSMNTEAF | SEQ ID NO: 3180 |
| ASSSDRAYEQY | SEQ ID NO: 3181 |
| ASSEGSTDTQY | SEQ ID NO: 3182 |
| ASSLVSSTDTQY | SEQ ID NO: 3183 |
| ASSFGTSYEQY | SEQ ID NO: 3184 |
| ASSSSGGSYNEQF | SEQ ID NO: 3185 |
| ASSGPYEQY | SEQ ID NO: 3186 |
| ASSLAGTQETQY | SEQ ID NO: 3187 |
| ASSHGETQY | SEQ ID NO: 3188 |
| ASSPRDEQF | SEQ ID NO: 3189 |
| ASSLDRTEAF | SEQ ID NO: 3190 |
| ASSSGGSGNTIY | SEQ ID NO: 3191 |
| ASSQVGTDTQY | SEQ ID NO: 3192 |
| ASRLAGGNEQF | SEQ ID NO: 3193 |
| ASSSQNTEAF | SEQ ID NO: 3194 |
| ASSLGTAGNTIY | SEQ ID NO: 3195 |
| ASSLVSQETQY | SEQ ID NO: 3196 |
| ASSLYNQPQH | SEQ ID NO: 3197 |
| ASSRDFTDTQY | SEQ ID NO: 3198 |
| ASSLAGVYEQY | SEQ ID NO: 3199 |
| ASSGDRNTEAF | SEQ ID NO: 3200 |

TABLE I-continued

| Sequence | Sequence ID No |
|---|---|
| ASSYRGGTEAF | SEQ ID NO: 3201 |
| ASSLGLADNEQF | SEQ ID NO: 3202 |
| ASSLTTNTEAF | SEQ ID NO: 3203 |
| ASSPGQNYEQY | SEQ ID NO: 3204 |
| ASSLGQGNTGELF | SEQ ID NO: 3205 |
| ASSPGLAQETQY | SEQ ID NO: 3206 |
| ASSLDPSTDTQY | SEQ ID NO: 3207 |
| ASSTAYEQY | SEQ ID NO: 3208 |
| ASSLAAYNEQF | SEQ ID NO: 3209 |
| ASSLTGGDTEAF | SEQ ID NO: 3210 |
| ASSLGTVYEQY | SEQ ID NO: 3211 |
| ASSGLAGYNEQF | SEQ ID NO: 3212 |
| ASSLGRDYGYT | SEQ ID NO: 3213 |
| ASSRQGGQPQH | SEQ ID NO: 3214 |
| ASSWDRGYEQY | SEQ ID NO: 3215 |
| ASSRSGSSYNEQF | SEQ ID NO: 3216 |
| ASSRGPQETQY | SEQ ID NO: 3217 |
| ASSYGNQPQH | SEQ ID NO: 3218 |
| ASSLTNYGYT | SEQ ID NO: 3219 |
| ASSFTANTEAF | SEQ ID NO: 3220 |
| ASSRGNTIY | SEQ ID NO: 3221 |
| ASSPLAGSYNEQF | SEQ ID NO: 3222 |
| ASSLGQGVYEQY | SEQ ID NO: 3223 |
| ASSPGGGNTEAF | SEQ ID NO: 3224 |
| ASSPQLNTEAF | SEQ ID NO: 3225 |
| ASSTRTDTQY | SEQ ID NO: 3226 |
| ASSSGQPNTEAF | SEQ ID NO: 3227 |
| ASSLGHSYEQY | SEQ ID NO: 3228 |
| ASSSTSGSYEQY | SEQ ID NO: 3229 |
| ASSFGTGAYEQY | SEQ ID NO: 3230 |
| ASSGLNTEAF | SEQ ID NO: 3231 |
| ASSLDRATEAF | SEQ ID NO: 3232 |
| ASSPGSNTEAF | SEQ ID NO: 3233 |
| ASSLADTEAF | SEQ ID NO: 3234 |
| ASSLGLAGAYEQY | SEQ ID NO: 3235 |
| ASSLVPTDTQY | SEQ ID NO: 3236 |
| ASSTGGYEQY | SEQ ID NO: 3237 |
| ASSRTANYGYT | SEQ ID NO: 3238 |
| ASSRNYGYT | SEQ ID NO: 3239 |
| ASSPGTGDQPQH | SEQ ID NO: 3240 |
| ASSLGQGQPQH | SEQ ID NO: 3241 |
| ASSPGTANQPQH | SEQ ID NO: 3242 |
| ASSRNEQF | SEQ ID NO: 3243 |
| ASSIRETQY | SEQ ID NO: 3244 |
| ASSLRQGAYEQY | SEQ ID NO: 3245 |
| ASSLGGPQETQY | SEQ ID NO: 3246 |
| ASSLSSQETQY | SEQ ID NO: 3247 |
| ASSLAGDYEQY | SEQ ID NO: 3248 |
| ASSLTSGTYNEQF | SEQ ID NO: 3249 |
| ASSLRDNEQF | SEQ ID NO: 3250 |
| ASSQEGTDTQY | SEQ ID NO: 3251 |
| ASRTGLNTEAF | SEQ ID NO: 3252 |
| ASSLGFQETQY | SEQ ID NO: 3253 |
| ASSSGQGGTEAF | SEQ ID NO: 3254 |
| ASSLAGDYGYT | SEQ ID NO: 3255 |
| ASSFGQTYEQY | SEQ ID NO: 3256 |
| ASSLIGYEQY | SEQ ID NO: 3257 |
| ASSQGGGTDTQY | SEQ ID NO: 3258 |
| ASSFGNSPLH | SEQ ID NO: 3259 |
| ASSTSGSTDTQY | SEQ ID NO: 3260 |
| ASSYRLNTEAF | SEQ ID NO: 3261 |
| ASSPAGNTEAF | SEQ ID NO: 3262 |
| ASRYTDTQY | SEQ ID NO: 3263 |
| ASSTGMNTEAF | SEQ ID NO: 3264 |
| ASSGTGGYEQY | SEQ ID NO: 3265 |
| ASSLGQGGTDTQY | SEQ ID NO: 3266 |
| ASSYGSSYNEQF | SEQ ID NO: 3267 |
| ASSPTGELF | SEQ ID NO: 3268 |
| ASSSGTSSYNEQF | SEQ ID NO: 3269 |
| ASSGQSNQPQH | SEQ ID NO: 3270 |
| ASSRDYQETQY | SEQ ID NO: 3271 |
| ASSPRTGTYEQY | SEQ ID NO: 3272 |
| ASSLGENQPQH | SEQ ID NO: 3273 |
| ASSFSSGANVLT | SEQ ID NO: 3274 |
| ASSRYTDTQY | SEQ ID NO: 3275 |
| ASSWDSYNEQF | SEQ ID NO: 3276 |
| ASSPGAQETQY | SEQ ID NO: 3277 |
| ASSPGGTYEQY | SEQ ID NO: 3278 |

TABLE I-continued

| Sequence | Sequence ID No |
|---|---|
| ASSLTEETQY | SEQ ID NO: 3279 |
| ASSQGYTEAF | SEQ ID NO: 3280 |
| ASSVGGTEAF | SEQ ID NO: 3281 |
| ASSPGQGGYGYT | SEQ ID NO: 3282 |
| ASSLGGGNTIY | SEQ ID NO: 3283 |
| ASSFGTGNTEAF | SEQ ID NO: 3284 |
| ASSPDSSGNTIY | SEQ ID NO: 3285 |
| ASSLTGQPQH | SEQ ID NO: 3286 |
| ASSPRGQPQH | SEQ ID NO: 3287 |
| ASSPGGGYGYT | SEQ ID NO: 3288 |
| ASSLIQETQY | SEQ ID NO: 3289 |
| ASSWGGNTEAF | SEQ ID NO: 3290 |
| ASSSTGSTDTQY | SEQ ID NO: 3291 |
| ASSLTDSYEQY | SEQ ID NO: 3292 |
| ASSLGGGTYEQY | SEQ ID NO: 3293 |
| ASSLGGGGTDTQY | SEQ ID NO: 3294 |
| ASSSTSGSTDTQY | SEQ ID NO: 3295 |
| ASSLGVEQY | SEQ ID NO: 3296 |
| ASSEAGGTDTQY | SEQ ID NO: 3297 |
| ASSPDRGSYNEQF | SEQ ID NO: 3298 |
| ASSSDLNTEAF | SEQ ID NO: 3299 |
| ASSFSQETQY | SEQ ID NO: 3300 |
| ASSPPGYNEQF | SEQ ID NO: 3301 |
| ASSPGRDQPQH | SEQ ID NO: 3302 |
| ASSLTATNEKLF | SEQ ID NO: 3303 |
| ASSPGGEQF | SEQ ID NO: 3304 |
| ASSLGPEQY | SEQ ID NO: 3305 |
| ASRQGGTEAF | SEQ ID NO: 3306 |
| ASSLGGQNTEAF | SEQ ID NO: 3307 |
| ASSLDRNNEQF | SEQ ID NO: 3308 |
| ASSSNSPLH | SEQ ID NO: 3309 |
| ASSFHNEQF | SEQ ID NO: 3310 |
| ASSLGPGTEAF | SEQ ID NO: 3311 |
| ASSLSYQETQY | SEQ ID NO: 3312 |
| ASSLGGGAYEQY | SEQ ID NO: 3313 |
| SARDRGYEQY | SEQ ID NO: 3314 |
| ASSPGQSSYNEQF | SEQ ID NO: 3315 |
| ASSIQGNQPQH | SEQ ID NO: 3316 |
| ASSNYEQY | SEQ ID NO: 3317 |
| ASSYGTGGYEQY | SEQ ID NO: 3318 |
| ASSLRGNTIY | SEQ ID NO: 3319 |
| ASSLDSGANVLT | SEQ ID NO: 3320 |
| ASSFPGQPQH | SEQ ID NO: 3321 |
| ASSWTSGSYEQY | SEQ ID NO: 3322 |
| ASSRTSGTYEQY | SEQ ID NO: 3323 |
| ASSPLAGSTDTQY | SEQ ID NO: 3324 |
| ASSGTGYEQY | SEQ ID NO: 3325 |
| ASSFRGEQY | SEQ ID NO: 3326 |
| ASSLDLNQPQH | SEQ ID NO: 3327 |
| ASSSPGQGSYEQY | SEQ ID NO: 3328 |
| ASSGQGGQPQH | SEQ ID NO: 3329 |
| AISESTDTQY | SEQ ID NO: 3330 |
| ASSLLGQETQY | SEQ ID NO: 3331 |
| ASSAGNQPQH | SEQ ID NO: 3332 |
| ASSYGGSSYEQY | SEQ ID NO: 3333 |
| ASSLSASTDTQY | SEQ ID NO: 3334 |
| ASSSDRGTEAF | SEQ ID NO: 3335 |
| ASSLTSSTDTQY | SEQ ID NO: 3336 |
| ASSQGLAGTDTQY | SEQ ID NO: 3337 |
| ASRLAGTDTQY | SEQ ID NO: 3338 |
| ASSSDRGYGYT | SEQ ID NO: 3339 |
| ASSDSSGSTDTQY | SEQ ID NO: 3340 |
| ASRQGSYEQY | SEQ ID NO: 3341 |
| ASSLGGANYGYT | SEQ ID NO: 3342 |
| ASSSRGDTQY | SEQ ID NO: 3343 |
| ASSPGLAGSTDTQY | SEQ ID NO: 3344 |
| ASSLTGATEAF | SEQ ID NO: 3345 |
| ASSSNNQPQH | SEQ ID NO: 3346 |
| ASSLASGSTDTQY | SEQ ID NO: 3347 |
| ASSLQGSSYNEQF | SEQ ID NO: 3348 |
| ASSSDRDTEAF | SEQ ID NO: 3349 |
| ASSSETQY | SEQ ID NO: 3350 |
| ASSVTYEQY | SEQ ID NO: 3351 |
| ASSRDFQETQY | SEQ ID NO: 3352 |
| ASSLASNTEAF | SEQ ID NO: 3353 |
| ASSQVRNTEAF | SEQ ID NO: 3354 |
| ASSWDSYEQY | SEQ ID NO: 3355 |
| ASSSTGSSYEQY | SEQ ID NO: 3356 |

TABLE I-continued

| Sequence | Sequence ID No |
|---|---|
| ASSLGGAGANVLT | SEQ ID NO: 3357 |
| ASSIGGSSYNEQF | SEQ ID NO: 3358 |
| ASSLAPNQPQH | SEQ ID NO: 3359 |
| ASSLGGSSTDTQY | SEQ ID NO: 3360 |
| ASSLGSGELF | SEQ ID NO: 3361 |
| ASSRGGNEQF | SEQ ID NO: 3362 |
| ASSQEGETQY | SEQ ID NO: 3363 |
| ASSRDMNTEAF | SEQ ID NO: 3364 |
| ASRLYNEQF | SEQ ID NO: 3365 |
| ASSLGRGYGYT | SEQ ID NO: 3366 |
| ASSLRDRGYEQY | SEQ ID NO: 3367 |
| SARGGTEAF | SEQ ID NO: 3368 |
| ASSLGVETQY | SEQ ID NO: 3369 |
| ASRGDTEAF | SEQ ID NO: 3370 |
| ASSLTGGYNEQF | SEQ ID NO: 3371 |
| ASSLGSGTEAF | SEQ ID NO: 3372 |
| ASSLATYEQY | SEQ ID NO: 3373 |
| ASSPRQGPYEQY | SEQ ID NO: 3374 |
| ASSFGSSGNTIY | SEQ ID NO: 3375 |
| ASSQKETQY | SEQ ID NO: 3376 |
| ASSLSSGTDTQY | SEQ ID NO: 3377 |
| ASSLGQVYEQY | SEQ ID NO: 3378 |
| ASSQGGNYGYT | SEQ ID NO: 3379 |
| ASSLGGAGTEAF | SEQ ID NO: 3380 |
| ASSQVGQPQH | SEQ ID NO: 3381 |
| ASSRDRLNTEAF | SEQ ID NO: 3382 |
| ASSTGGNTEAF | SEQ ID NO: 3383 |
| ASSLGLASTDTQY | SEQ ID NO: 3384 |
| ASSLEVNQPQH | SEQ ID NO: 3385 |
| ASSQGSSYNEQF | SEQ ID NO: 3386 |
| ASSELAGGYNEQF | SEQ ID NO: 3387 |
| ASSSSGDTQY | SEQ ID NO: 3388 |
| ASSYRGSYEQY | SEQ ID NO: 3389 |
| ASSLEGSYNEQF | SEQ ID NO: 3390 |
| ASSPSTEAF | SEQ ID NO: 3391 |
| ASRLQETQY | SEQ ID NO: 3392 |
| ASSSTGDTEAF | SEQ ID NO: 3393 |
| ASGSSYEQY | SEQ ID NO: 3394 |
| ASSGTSGSYEQY | SEQ ID NO: 3395 |
| ASSQGLAGSYEQY | SEQ ID NO: 3396 |
| ASSLGPSNQPQH | SEQ ID NO: 3397 |
| ASSLRTSTDTQY | SEQ ID NO: 3398 |
| ASSLRGRNTEAF | SEQ ID NO: 3399 |
| ASSLKGDTEAF | SEQ ID NO: 3400 |
| ASSFEGNTEAF | SEQ ID NO: 3401 |
| ASSLYGNTEAF | SEQ ID NO: 3402 |
| ASSFSGQPQH | SEQ ID NO: 3403 |
| ASSFLAGTDTQY | SEQ ID NO: 3404 |
| ASSLPGANVLT | SEQ ID NO: 3405 |
| ASSLTGYSNQPQH | SEQ ID NO: 3406 |
| ASSLGQLYGYT | SEQ ID NO: 3407 |
| ASSGDTDTQY | SEQ ID NO: 3408 |
| ASSLGSTYEQY | SEQ ID NO: 3409 |
| ASSLGGKETQY | SEQ ID NO: 3410 |
| ASSLGLEETQY | SEQ ID NO: 3411 |
| ASSSDNEQF | SEQ ID NO: 3412 |
| ASSLVGGSYNEQF | SEQ ID NO: 3413 |
| ASSSNQETQY | SEQ ID NO: 3414 |
| ASSLGQQNTEAF | SEQ ID NO: 3415 |
| ASSQGPQETQY | SEQ ID NO: 3416 |
| ASSLWENTEAF | SEQ ID NO: 3417 |
| ASSLGPGTDTQY | SEQ ID NO: 3418 |
| ASSPRTSGYNEQF | SEQ ID NO: 3419 |
| ASSLTGGADTQY | SEQ ID NO: 3420 |
| ASSVGMNTEAF | SEQ ID NO: 3421 |
| ASSQMNTEAF | SEQ ID NO: 3422 |
| ASSFGTVNTEAF | SEQ ID NO: 3423 |
| ASSLSYSNQPQH | SEQ ID NO: 3424 |
| ASSFLGETQY | SEQ ID NO: 3425 |
| ASSLDGGTEAF | SEQ ID NO: 3426 |
| ASSPGQSYGYT | SEQ ID NO: 3427 |
| ASSLVSGNTIY | SEQ ID NO: 3428 |
| ASTNTDTQY | SEQ ID NO: 3429 |
| ASSLAQGNTEAF | SEQ ID NO: 3430 |
| ASSRRDTQY | SEQ ID NO: 3431 |
| ASSYGGSTDTQY | SEQ ID NO: 3432 |
| ASSTGSNQPQH | SEQ ID NO: 3433 |
| ASRVTDTQY | SEQ ID NO: 3434 |

TABLE I-continued

| Sequence | Sequence ID No |
|---|---|
| ASSLSGGGTEAF | SEQ ID NO: 3435 |
| ASSSGTGTDTQY | SEQ ID NO: 3436 |
| ASSQVGDTQY | SEQ ID NO: 3437 |
| ASSVGPNTEAF | SEQ ID NO: 3438 |
| ASSDSNTGELF | SEQ ID NO: 3439 |
| ASSLSDQPQH | SEQ ID NO: 3440 |
| ASSPGLTYEQY | SEQ ID NO: 3441 |
| ASSLDGTEAF | SEQ ID NO: 3442 |
| ASSQGYSNQPQH | SEQ ID NO: 3443 |
| ASSLGGSEAF | SEQ ID NO: 3444 |
| ASSLGLASYEQY | SEQ ID NO: 3445 |
| ASSYSSGNTIY | SEQ ID NO: 3446 |
| ASRGLNTEAF | SEQ ID NO: 3447 |
| ASSFRDQPQH | SEQ ID NO: 3448 |
| ASSLVSETQY | SEQ ID NO: 3449 |
| ASSPGDEQY | SEQ ID NO: 3450 |
| ASSLAQGYEQY | SEQ ID NO: 3451 |
| ASSLGLGTEAF | SEQ ID NO: 3452 |
| ASSLAGDTDTQY | SEQ ID NO: 3453 |
| ASSRTGNTGELF | SEQ ID NO: 3454 |
| ASSPAGTDTQY | SEQ ID NO: 3455 |
| ASSLRGDYGYT | SEQ ID NO: 3456 |
| ASSQQGGTEAF | SEQ ID NO: 3457 |
| ASSLGGRNQPQH | SEQ ID NO: 3458 |
| ASSLVRDTEAF | SEQ ID NO: 3459 |
| ASSLLDTEAF | SEQ ID NO: 3460 |
| ASSQAGNTEAF | SEQ ID NO: 3461 |
| ASSLGLNYGYT | SEQ ID NO: 3462 |
| ASSWTSGSTDTQY | SEQ ID NO: 3463 |
| ASSLGEQF | SEQ ID NO: 3464 |
| ASSLLRDTQY | SEQ ID NO: 3465 |
| ASSPSGGSYEQY | SEQ ID NO: 3466 |
| ASRGGGTDTQY | SEQ ID NO: 3467 |
| ASSLGPSSYEQY | SEQ ID NO: 3468 |
| ASSGQANTEAF | SEQ ID NO: 3469 |
| ASSQDTEAF | SEQ ID NO: 3470 |
| ASSPGANYGYT | SEQ ID NO: 3471 |
| SARDSSYEQY | SEQ ID NO: 3472 |
| ASSQGSYGYT | SEQ ID NO: 3473 |
| ASSLRPDTQY | SEQ ID NO: 3474 |
| ASSQGTNTEAF | SEQ ID NO: 3475 |
| ASSQDYNEQF | SEQ ID NO: 3476 |
| ASSQRDTQY | SEQ ID NO: 3477 |
| ASSQDRGDTQY | SEQ ID NO: 3478 |
| ASSVGTEAF | SEQ ID NO: 3479 |
| ASSLRPYEQY | SEQ ID NO: 3480 |
| ASSGNYGYT | SEQ ID NO: 3481 |
| ASSQGLAGYNEQF | SEQ ID NO: 3482 |
| ASSETVNTEAF | SEQ ID NO: 3483 |
| ASSAGGTDTQY | SEQ ID NO: 3484 |
| ASSLAGLTDTQY | SEQ ID NO: 3485 |
| ASSLRENQPQH | SEQ ID NO: 3486 |
| ASSLGHTDTQY | SEQ ID NO: 3487 |
| ASSQGLYNEQF | SEQ ID NO: 3488 |
| ASSLLAGQETQY | SEQ ID NO: 3489 |
| ASSLGFYEQY | SEQ ID NO: 3490 |
| ASSLGVGQPQH | SEQ ID NO: 3491 |
| ASSLAGSYGYT | SEQ ID NO: 3492 |
| ASSSHTDTQY | SEQ ID NO: 3493 |
| ASSLSRQETQY | SEQ ID NO: 3494 |
| ASSRQGSSYEQY | SEQ ID NO: 3495 |
| ASSLGTGGYNEQF | SEQ ID NO: 3496 |
| ASSSGQGADTQY | SEQ ID NO: 3497 |
| ASSYGENTEAF | SEQ ID NO: 3498 |
| ASSLGGTTDTQY | SEQ ID NO: 3499 |
| ASSSDRNYGYT | SEQ ID NO: 3500 |
| ASSSGQGQETQY | SEQ ID NO: 3501 |
| ASSPGASTDTQY | SEQ ID NO: 3502 |
| ASSEGDTQY | SEQ ID NO: 3503 |
| ASSPDRSSYEQY | SEQ ID NO: 3504 |
| ASSPTGGQETQY | SEQ ID NO: 3505 |
| ASSYPDTQY | SEQ ID NO: 3506 |
| ASSPRLAGGTDTQY | SEQ ID NO: 3507 |
| ASSLPSSYEQY | SEQ ID NO: 3508 |
| ASSRTSYEQY | SEQ ID NO: 3509 |
| ASSLLAGGNEQF | SEQ ID NO: 3510 |
| ASSRDRNTGELF | SEQ ID NO: 3511 |
| ASSLHSNQPQH | SEQ ID NO: 3512 |

TABLE I-continued

| Sequence | Sequence ID No |
|---|---|
| ASSSGQGNSPLH | SEQ ID NO: 3513 |
| ASSVGNEQF | SEQ ID NO: 3514 |
| ASSGGDTQY | SEQ ID NO: 3515 |
| ASSFDGNTEAF | SEQ ID NO: 3516 |
| ASSLGLEQY | SEQ ID NO: 3517 |
| ASSVGRNTEAF | SEQ ID NO: 3518 |
| ASSPGRNYGYT | SEQ ID NO: 3519 |
| ASSRGPYEQY | SEQ ID NO: 3520 |
| ASSWTGGNQPQH | SEQ ID NO: 3521 |
| ASSLGRDNEQF | SEQ ID NO: 3522 |
| ASSLLGEQF | SEQ ID NO: 3523 |
| ASSPGQPNTEAF | SEQ ID NO: 3524 |
| ASSPTGYTEAF | SEQ ID NO: 3525 |
| ASSPAGYEQY | SEQ ID NO: 3526 |
| ASSLIGNEQF | SEQ ID NO: 3527 |
| ASSQDRGSYNEQF | SEQ ID NO: 3528 |
| ASSLAANYGYT | SEQ ID NO: 3529 |
| ASSLVLETQY | SEQ ID NO: 3530 |
| ASSIGLNTEAF | SEQ ID NO: 3531 |
| ASSLGEGTEAF | SEQ ID NO: 3532 |
| ASSFGDSNQPQH | SEQ ID NO: 3533 |
| ASSPDRVYGYT | SEQ ID NO: 3534 |
| SARDGNQPQH | SEQ ID NO: 3535 |
| ASSLRSYNEQF | SEQ ID NO: 3536 |
| ASSFGGTYEQY | SEQ ID NO: 3537 |
| ASSQTGGNQPQH | SEQ ID NO: 3538 |
| ASSLRGAYEQY | SEQ ID NO: 3539 |
| ASSQVGGNTEAF | SEQ ID NO: 3540 |
| ASSLDRGNYGYT | SEQ ID NO: 3541 |
| ASSAQGYEQY | SEQ ID NO: 3542 |
| ASSSSSGANVLT | SEQ ID NO: 3543 |
| ASSFGGADTQY | SEQ ID NO: 3544 |
| ASSLLDQPQH | SEQ ID NO: 3545 |
| ASSSSYGYT | SEQ ID NO: 3546 |
| ASSRGTYEQY | SEQ ID NO: 3547 |
| ASSTGQNTEAF | SEQ ID NO: 3548 |
| ASSIGNTEAF | SEQ ID NO: 3549 |
| ASSLVGVNTEAF | SEQ ID NO: 3550 |
| ASSPAGGTDTQY | SEQ ID NO: 3551 |
| ASSQRTDTQY | SEQ ID NO: 3552 |
| ASSLVRNEQF | SEQ ID NO: 3553 |
| ASSFGGEQF | SEQ ID NO: 3554 |
| ASSFQGSNQPQH | SEQ ID NO: 3555 |
| ASSLGTGGNEQF | SEQ ID NO: 3556 |
| ASSYEETQY | SEQ ID NO: 3557 |
| ASSAEETQY | SEQ ID NO: 3558 |
| SARQGGTEAF | SEQ ID NO: 3559 |
| ASSQVGTEAF | SEQ ID NO: 3560 |
| SAREGNQPQH | SEQ ID NO: 3561 |
| ASSLDGGNQPQH | SEQ ID NO: 3562 |
| ASSPSGGNQPQH | SEQ ID NO: 3563 |
| ASSFLAGGTDTQY | SEQ ID NO: 3564 |
| ASSGQNTEAF | SEQ ID NO: 3565 |
| ASSLNRGYEQY | SEQ ID NO: 3566 |
| ASSSRLNTEAF | SEQ ID NO: 3567 |
| ASSSGYSNQPQH | SEQ ID NO: 3568 |
| ASSLGSETQY | SEQ ID NO: 3569 |
| ASSLRQLNTEAF | SEQ ID NO: 3570 |
| ASSYSADTQY | SEQ ID NO: 3571 |
| ASSLRRTDTQY | SEQ ID NO: 3572 |
| ASSLGQGNEQY | SEQ ID NO: 3573 |
| ASSWNTEAF | SEQ ID NO: 3574 |
| ASSQGGSGNTIY | SEQ ID NO: 3575 |
| ASSPRTENTEAF | SEQ ID NO: 3576 |
| ASSQGRDQPQH | SEQ ID NO: 3577 |
| ASSLAGGNNEQF | SEQ ID NO: 3578 |
| ASSYRDTGELF | SEQ ID NO: 3579 |
| ASSFTGYEQY | SEQ ID NO: 3580 |
| ASSLGQGPYNEQF | SEQ ID NO: 3581 |
| ASSLARSYEQY | SEQ ID NO: 3582 |
| ASSLGQIYEQY | SEQ ID NO: 3583 |
| ASSLGLAVYNEQF | SEQ ID NO: 3584 |
| ASSFRDTEAF | SEQ ID NO: 3585 |
| ASSLARGYEQY | SEQ ID NO: 3586 |
| ASSSSGETQY | SEQ ID NO: 3587 |
| ASSLGSLNTEAF | SEQ ID NO: 3588 |
| ASSLTPYEQY | SEQ ID NO: 3589 |
| ASSPRSYNEQF | SEQ ID NO: 3590 |

TABLE I-continued

| Sequence | Sequence ID No |
|---|---|
| ASSLGGYEQF | SEQ ID NO: 3591 |
| ASSPGRTEAF | SEQ ID NO: 3592 |
| ASSLGTSSYEQY | SEQ ID NO: 3593 |
| ASSLAGGNTIY | SEQ ID NO: 3594 |
| ASSLASETQY | SEQ ID NO: 3595 |
| ASSLRVTDTQY | SEQ ID NO: 3596 |
| ASSLDPDTQY | SEQ ID NO: 3597 |
| ASSLGQSYNEQF | SEQ ID NO: 3598 |
| ASSLQNQPQH | SEQ ID NO: 3599 |
| ASSSRSSYEQY | SEQ ID NO: 3600 |
| ASSLISYEQY | SEQ ID NO: 3601 |
| ASSLQGRETQY | SEQ ID NO: 3602 |
| ASSLAPSYEQY | SEQ ID NO: 3603 |
| ASSYGGETQY | SEQ ID NO: 3604 |
| ASSSLGETQY | SEQ ID NO: 3605 |
| ASSQDLGYEQY | SEQ ID NO: 3606 |
| ASSPDRGQPQH | SEQ ID NO: 3607 |
| ASSLNGYEQY | SEQ ID NO: 3608 |
| ASSLGQGGEQY | SEQ ID NO: 3609 |
| ASSLRGGYGYT | SEQ ID NO: 3610 |
| ASSLGLDNEQF | SEQ ID NO: 3611 |
| ASSPQGDYGYT | SEQ ID NO: 3612 |
| ASSYRGDTEAF | SEQ ID NO: 3613 |
| ASSSYNSPLH | SEQ ID NO: 3614 |
| ASGNTEAF | SEQ ID NO: 3615 |
| ASSLSGGSTDTQY | SEQ ID NO: 3616 |
| ASSFSSSYEQY | SEQ ID NO: 3617 |
| ASSLGGLQETQY | SEQ ID NO: 3618 |
| ASSLESSYEQY | SEQ ID NO: 3619 |
| ASSLENTGELF | SEQ ID NO: 3620 |
| ASSTSSYEQY | SEQ ID NO: 3621 |
| ASSSTGDTQY | SEQ ID NO: 3622 |
| ASSLGGTSYEQY | SEQ ID NO: 3623 |
| ASSLSRSTDTQY | SEQ ID NO: 3624 |
| ASSPGGAYEQY | SEQ ID NO: 3625 |
| ASSVGGNQPQH | SEQ ID NO: 3626 |
| ASSLQQNTEAF | SEQ ID NO: 3627 |
| ASSTRETQY | SEQ ID NO: 3628 |
| ASSSRENTEAF | SEQ ID NO: 3629 |
| ASSPQGYTEAF | SEQ ID NO: 3630 |
| ASSLSHEQY | SEQ ID NO: 3631 |
| ASSPAGDTQY | SEQ ID NO: 3632 |
| ASSSGPQETQY | SEQ ID NO: 3633 |
| ASSYPNQPQH | SEQ ID NO: 3634 |
| ASSEGVNTEAF | SEQ ID NO: 3635 |
| ASSQDRGSYEQY | SEQ ID NO: 3636 |
| ASSQDPNQPQH | SEQ ID NO: 3637 |
| ASSPRTGAYEQY | SEQ ID NO: 3638 |
| ASSLARDQPQH | SEQ ID NO: 3639 |
| ASSSGLAYEQY | SEQ ID NO: 3640 |
| ASSSGAYNEQF | SEQ ID NO: 3641 |
| ASSKQETQY | SEQ ID NO: 3642 |
| ASSPPGNTIY | SEQ ID NO: 3643 |
| ASSQTGNQPQH | SEQ ID NO: 3644 |
| ASSSTSGSYNEQF | SEQ ID NO: 3645 |
| ASSLTSGTYEQY | SEQ ID NO: 3646 |
| ASSTYTDTQY | SEQ ID NO: 3647 |
| ASSLTGGSNQPQH | SEQ ID NO: 3648 |
| ASSTDSNQPQH | SEQ ID NO: 3649 |
| ASSLGGFTDTQY | SEQ ID NO: 3650 |
| ASSPGQPYEQY | SEQ ID NO: 3651 |
| ASSLGGEKLF | SEQ ID NO: 3652 |
| ASSPRSSYNEQF | SEQ ID NO: 3653 |
| ASSEGTEAF | SEQ ID NO: 3654 |
| ASSSDRGNQPQH | SEQ ID NO: 3655 |
| ASSVSNQPQH | SEQ ID NO: 3656 |
| ASSLRQQETQY | SEQ ID NO: 3657 |
| ASSLVGMNTEAF | SEQ ID NO: 3658 |
| ASSFTETQY | SEQ ID NO: 3659 |
| ASSENYEQY | SEQ ID NO: 3660 |
| ASSRKETQY | SEQ ID NO: 3661 |
| ASRTVNTEAF | SEQ ID NO: 3662 |
| ASSLGSGNQPQH | SEQ ID NO: 3663 |
| ASSQGGGYT | SEQ ID NO: 3664 |
| ASSLGLTEAF | SEQ ID NO: 3665 |
| ASSLPGNEQF | SEQ ID NO: 3666 |
| ASSSRMNTEAF | SEQ ID NO: 3667 |
| ASSYGQGAYEQY | SEQ ID NO: 3668 |

TABLE I-continued

| Sequence | Sequence ID No |
|---|---|
| ASSPTANYGYT | SEQ ID NO: 3669 |
| ASSSRDRGYEQY | SEQ ID NO: 3670 |
| ASSSPGQGTDTQY | SEQ ID NO: 3671 |
| ASSETSGSTDTQY | SEQ ID NO: 3672 |
| ASSSQLNTEAF | SEQ ID NO: 3673 |
| ASSPSPYEQY | SEQ ID NO: 3674 |
| ASSLGHEQF | SEQ ID NO: 3675 |
| ASSPPSQETQY | SEQ ID NO: 3676 |
| ASSSGGNQPQH | SEQ ID NO: 3677 |
| ASSSTGGYEQY | SEQ ID NO: 3678 |
| ASSFGQLNTEAF | SEQ ID NO: 3679 |
| ASSLTSNTEAF | SEQ ID NO: 3680 |
| ASSFQGDTEAF | SEQ ID NO: 3681 |
| ASSLVDEQY | SEQ ID NO: 3682 |
| ASSLGVMNTEAF | SEQ ID NO: 3683 |
| ASSFRLNTEAF | SEQ ID NO: 3684 |
| ASSYGTGSYEQY | SEQ ID NO: 3685 |
| ASSPGTSGTYEQY | SEQ ID NO: 3686 |
| ASSLRTANTEAF | SEQ ID NO: 3687 |
| ASSLGTTEAF | SEQ ID NO: 3688 |
| ASSLGGTQETQY | SEQ ID NO: 3689 |
| ASSQGPYNEQF | SEQ ID NO: 3690 |
| ASSSLGYEQY | SEQ ID NO: 3691 |
| ASRDSYNEQF | SEQ ID NO: 3692 |
| ASSLESDTQY | SEQ ID NO: 3693 |
| ASSQGSTEAF | SEQ ID NO: 3694 |
| ASSPDRGETQY | SEQ ID NO: 3695 |
| ASSLAGQGYEQY | SEQ ID NO: 3696 |
| ASRGTANTEAF | SEQ ID NO: 3697 |
| ASSSGGSSYEQY | SEQ ID NO: 3698 |
| ASSGLAGGTDTQY | SEQ ID NO: 3699 |
| ASSLVGEETQY | SEQ ID NO: 3700 |
| ASSEGSYEQY | SEQ ID NO: 3701 |
| ASSPGGDTEAF | SEQ ID NO: 3702 |
| ASSQDNEQF | SEQ ID NO: 3703 |
| ASSLAGGAYNEQF | SEQ ID NO: 3704 |
| ASSFTGGNQPQH | SEQ ID NO: 3705 |
| ASSSRGGTEAF | SEQ ID NO: 3706 |
| ASSLAGYSNQPQH | SEQ ID NO: 3707 |
| ASSSTGSSYNEQF | SEQ ID NO: 3708 |
| ASSLGSSYNSPLH | SEQ ID NO: 3709 |
| ASSLDGGTDTQY | SEQ ID NO: 3710 |
| ASSLTGSNTEAF | SEQ ID NO: 3711 |
| ASSRPNTEAF | SEQ ID NO: 3712 |
| ASSLETEAF | SEQ ID NO: 3713 |
| ASSYPGTDTQY | SEQ ID NO: 3714 |
| ASSPGTGGYNEQF | SEQ ID NO: 3715 |
| ASSPTGDEQY | SEQ ID NO: 3716 |
| ASSQGQGTDTQY | SEQ ID NO: 3717 |
| ASSQGRTDTQY | SEQ ID NO: 3718 |
| ASSPGQGRETQY | SEQ ID NO: 3719 |
| ASSGTGQETQY | SEQ ID NO: 3720 |
| ASSQDSGNTIY | SEQ ID NO: 3721 |
| ASSLRAYEQY | SEQ ID NO: 3722 |
| ASSLGTSNEQF | SEQ ID NO: 3723 |
| ASSLSRDQPQH | SEQ ID NO: 3724 |
| ASSLKVNTEAF | SEQ ID NO: 3725 |
| ASSPGANVLT | SEQ ID NO: 3726 |
| ASSLIGDTQY | SEQ ID NO: 3727 |
| ASSESGYEQY | SEQ ID NO: 3728 |
| ASSPSGTEAF | SEQ ID NO: 3729 |
| ASSRTSGGYNEQF | SEQ ID NO: 3730 |
| ASSSDYNEQF | SEQ ID NO: 3731 |
| ASSLRRDTEAF | SEQ ID NO: 3732 |
| ASSRNQETQY | SEQ ID NO: 3733 |
| ASSSGLAGSTDTQY | SEQ ID NO: 3734 |
| ASSLAGNEQY | SEQ ID NO: 3735 |
| ASSSDRDQPQH | SEQ ID NO: 3736 |
| ASSFTNTEAF | SEQ ID NO: 3737 |
| ASSLGGDYEQY | SEQ ID NO: 3738 |
| ASSPSRETQY | SEQ ID NO: 3739 |
| ASSLSSGSYEQY | SEQ ID NO: 3740 |
| ASSLVGGEQY | SEQ ID NO: 3741 |
| ASSFTGDTEAF | SEQ ID NO: 3742 |
| ASSLSDEQF | SEQ ID NO: 3743 |
| ASSPGGGETQY | SEQ ID NO: 3744 |
| ASSQGGYNEQF | SEQ ID NO: 3745 |
| ASSPGTSGSTDTQY | SEQ ID NO: 3746 |

TABLE I-continued

| Sequence | Sequence ID No |
|---|---|
| ASSQTENTEAF | SEQ ID NO: 3747 |
| ASSFGRNQPQH | SEQ ID NO: 3748 |
| ASSWGRNTEAF | SEQ ID NO: 3749 |
| ASSPRNQPQH | SEQ ID NO: 3750 |
| ASRGGYEQY | SEQ ID NO: 3751 |
| ASSQGNTIY | SEQ ID NO: 3752 |
| ASSQGSNTEAF | SEQ ID NO: 3753 |
| ASSRGDEQF | SEQ ID NO: 3754 |
| ASSPDRSYGYT | SEQ ID NO: 3755 |
| ASSLDSNEQF | SEQ ID NO: 3756 |
| ASSFSADTQY | SEQ ID NO: 3757 |
| ASSLVTNTEAF | SEQ ID NO: 3758 |
| ASSFAGELF | SEQ ID NO: 3759 |
| ASSLDSSYNEQF | SEQ ID NO: 3760 |
| ASSRDGNYGYT | SEQ ID NO: 3761 |
| ASSLSLNQPQH | SEQ ID NO: 3762 |
| ASSVAGGTDTQY | SEQ ID NO: 3763 |
| ASSLGQGDYGYT | SEQ ID NO: 3764 |
| ASSRDRVYEQY | SEQ ID NO: 3765 |
| ASSTGTGSYEQY | SEQ ID NO: 3766 |
| ASSLQSSYEQY | SEQ ID NO: 3767 |
| ASSLGTGNTIY | SEQ ID NO: 3768 |
| ASSLLGADTQY | SEQ ID NO: 3769 |
| ASSFRGQPQH | SEQ ID NO: 3770 |
| ASSRTEETQY | SEQ ID NO: 3771 |
| ASSPRQGQETQY | SEQ ID NO: 3772 |
| ASSLTDYGYT | SEQ ID NO: 3773 |
| ASSPDRMNTEAF | SEQ ID NO: 3774 |
| ASSLGTSGNTIY | SEQ ID NO: 3775 |
| ASSRQGANTEAF | SEQ ID NO: 3776 |
| ASSFFTDTQY | SEQ ID NO: 3777 |
| ASSLDKNTEAF | SEQ ID NO: 3778 |
| ASSRYEQY | SEQ ID NO: 3779 |
| ASSRTGYGYT | SEQ ID NO: 3780 |
| ASSLGLAGGYEQY | SEQ ID NO: 3781 |
| ASRQGSNQPQH | SEQ ID NO: 3782 |
| ASSFGQSTDTQY | SEQ ID NO: 3783 |
| ASSFGGGETQY | SEQ ID NO: 3784 |
| ASSPTGGETQY | SEQ ID NO: 3785 |
| ASSLAGGSDTQY | SEQ ID NO: 3786 |
| ASSFGQMNTEAF | SEQ ID NO: 3787 |
| ASSTSSYNEQF | SEQ ID NO: 3788 |
| ASSPGLANEQF | SEQ ID NO: 3789 |
| ASSLAPQETQY | SEQ ID NO: 3790 |
| ASGDYEQY | SEQ ID NO: 3791 |
| ASSSGQGTYEQY | SEQ ID NO: 3792 |
| ASSSQGDTQY | SEQ ID NO: 3793 |
| ASSLLRTDTQY | SEQ ID NO: 3794 |
| ASRRGTDTQY | SEQ ID NO: 3795 |
| ASSLVRGTEAF | SEQ ID NO: 3796 |
| ASSLASGYEQY | SEQ ID NO: 3797 |
| ASSIGRNTEAF | SEQ ID NO: 3798 |
| ASSGQGAYEQY | SEQ ID NO: 3799 |
| ASSSASTDTQY | SEQ ID NO: 3800 |
| ASSFGPYEQY | SEQ ID NO: 3801 |
| ASSLGSSSYNEQF | SEQ ID NO: 3802 |
| ASSRGQGAYEQY | SEQ ID NO: 3803 |
| ASSFGSNTEAF | SEQ ID NO: 3804 |
| ASSEQGGTEAF | SEQ ID NO: 3805 |
| ASSQGTGSYEQY | SEQ ID NO: 3806 |
| ASSLGGRDTQY | SEQ ID NO: 3807 |
| ASSYKETQY | SEQ ID NO: 3808 |
| ASSTGNYGYT | SEQ ID NO: 3809 |
| ASSLFQETQY | SEQ ID NO: 3810 |
| ASSSGQGDQPQH | SEQ ID NO: 3811 |
| ASSLYGNQPQH | SEQ ID NO: 3812 |
| ASSLSGGYGYT | SEQ ID NO: 3813 |
| ASSIGGNQPQH | SEQ ID NO: 3814 |
| ASSDPYEQY | SEQ ID NO: 3815 |
| SASQETQY | SEQ ID NO: 3816 |
| ASSLQGSNTEAF | SEQ ID NO: 3817 |
| ASSLQGNTIY | SEQ ID NO: 3818 |
| ASSPGLAAYEQY | SEQ ID NO: 3819 |
| ASRGTSTDTQY | SEQ ID NO: 3820 |
| ASSFRDSSYEQY | SEQ ID NO: 3821 |
| ASSDGSTDTQY | SEQ ID NO: 3822 |
| ASSLRTVNTEAF | SEQ ID NO: 3823 |
| ASSRDYTDTQY | SEQ ID NO: 3824 |

TABLE I-continued

| Sequence | Sequence ID No |
|---|---|
| ASSRQGPYEQY | SEQ ID NO: 3825 |
| ASSLSGTQY | SEQ ID NO: 3826 |
| ASSPGLADNEQF | SEQ ID NO: 3827 |
| ASSRDNYGYT | SEQ ID NO: 3828 |
| ASSLAGGSSYEQY | SEQ ID NO: 3829 |
| ASSSLQETQY | SEQ ID NO: 3830 |
| ASSLPGETQY | SEQ ID NO: 3831 |
| ASSVGSTDTQY | SEQ ID NO: 3832 |
| ASSLVNSPLH | SEQ ID NO: 3833 |
| ASSLNSGANVLT | SEQ ID NO: 3834 |
| ASRSQETQY | SEQ ID NO: 3835 |
| ASSLATGELF | SEQ ID NO: 3836 |
| ASSPRGYGYT | SEQ ID NO: 3837 |
| ASSYGPNTEAF | SEQ ID NO: 3838 |
| ASSPDRSYEQY | SEQ ID NO: 3839 |
| ASSRGQGTDTQY | SEQ ID NO: 3840 |
| ASRYSNQPQH | SEQ ID NO: 3841 |
| ASSSQYEQY | SEQ ID NO: 3842 |
| ASSLRSDTQY | SEQ ID NO: 3843 |
| ASRRSTDTQY | SEQ ID NO: 3844 |
| ASSLGGENTEAF | SEQ ID NO: 3845 |
| ASSSLGTDTQY | SEQ ID NO: 3846 |
| ASSPPGNQPQH | SEQ ID NO: 3847 |
| ASSLAGVQETQY | SEQ ID NO: 3848 |
| ASSLNRETQY | SEQ ID NO: 3849 |
| ASSPPMNTEAF | SEQ ID NO: 3850 |
| ASSLGQLNQPQH | SEQ ID NO: 3851 |
| ASSLRGRETQY | SEQ ID NO: 3852 |
| ASSPQRNTEAF | SEQ ID NO: 3853 |
| ASSLSRYEQY | SEQ ID NO: 3854 |
| ASSPGLAGAYEQY | SEQ ID NO: 3855 |
| ASSPGLAGVNEQF | SEQ ID NO: 3856 |
| ASSRQGGETQY | SEQ ID NO: 3857 |
| ASRGQGGTEAF | SEQ ID NO: 3858 |
| ASSYDSYNEQF | SEQ ID NO: 3859 |
| ASSRTGYNEQF | SEQ ID NO: 3860 |
| ASSPDRSTDTQY | SEQ ID NO: 3861 |
| ASSSLGDTQY | SEQ ID NO: 3862 |
| ASSLVGRNTEAF | SEQ ID NO: 3863 |
| ASSLGLSSYEQY | SEQ ID NO: 3864 |
| ASSLGFNQPQH | SEQ ID NO: 3865 |
| ASSPQGAYEQY | SEQ ID NO: 3866 |
| ASSPDRANTEAF | SEQ ID NO: 3867 |
| ASSPTPNTEAF | SEQ ID NO: 3868 |
| ASSLPGELF | SEQ ID NO: 3869 |
| ASSFPGNTIY | SEQ ID NO: 3870 |
| ASSLRDSTDTQY | SEQ ID NO: 3871 |
| ASSFYTEAF | SEQ ID NO: 3872 |
| ATSDSNQPQH | SEQ ID NO: 3873 |
| ASSLEQETQY | SEQ ID NO: 3874 |
| ASSFPGELF | SEQ ID NO: 3875 |
| ASSLVSTEAF | SEQ ID NO: 3876 |
| ASSSTGMNTEAF | SEQ ID NO: 3877 |
| ASSLAPSTDTQY | SEQ ID NO: 3878 |
| ASSLAGLQETQY | SEQ ID NO: 3879 |
| ASSLSSSGNTIY | SEQ ID NO: 3880 |
| ASSQELNTEAF | SEQ ID NO: 3881 |
| ASSLLAGGQETQY | SEQ ID NO: 3882 |
| ASSPGLASYEQY | SEQ ID NO: 3883 |
| ASSPGTGGSYEQY | SEQ ID NO: 3884 |
| ASSLTGTGNTIY | SEQ ID NO: 3885 |
| ASSLGTSGQETQY | SEQ ID NO: 3886 |
| ASSPGTGGYGYT | SEQ ID NO: 3887 |
| ASSLDRGSNQPQH | SEQ ID NO: 3888 |
| ASSLTGGGQPQH | SEQ ID NO: 3889 |
| ASSLGQPNQPQH | SEQ ID NO: 3890 |
| ASSRGQGSYEQY | SEQ ID NO: 3891 |
| ASSFEGNQPQH | SEQ ID NO: 3892 |
| ASSQNSNQPQH | SEQ ID NO: 3893 |
| ASSLQGGGTEAF | SEQ ID NO: 3894 |
| ASSPSGYEQY | SEQ ID NO: 3895 |
| ASSLTSGNTIY | SEQ ID NO: 3896 |
| ASSPRGPYEQY | SEQ ID NO: 3897 |
| ASSLGDYNEQF | SEQ ID NO: 3898 |
| ASSSRDSYEQY | SEQ ID NO: 3899 |
| ASSGQGSYEQY | SEQ ID NO: 3900 |
| ASSQATDTQY | SEQ ID NO: 3901 |
| ASSLNRGETQY | SEQ ID NO: 3902 |

TABLE I-continued

| Sequence | Sequence ID No |
|---|---|
| ASSPREETQY | SEQ ID NO: 3903 |
| ASSPAGETQY | SEQ ID NO: 3904 |
| ASSYSGNTIY | SEQ ID NO: 3905 |
| ASGRNTEAF | SEQ ID NO: 3906 |
| ASSSTGNEQF | SEQ ID NO: 3907 |
| ASSLSGGQPQH | SEQ ID NO: 3908 |
| ASSLWETQY | SEQ ID NO: 3909 |
| ASSPGSGANVLT | SEQ ID NO: 3910 |
| SARENTEAF | SEQ ID NO: 3911 |
| ASSLGGAETQY | SEQ ID NO: 3912 |
| ASSLKGTDTQY | SEQ ID NO: 3913 |
| ASSLSGGAYEQY | SEQ ID NO: 3914 |
| ASSLRGGQETQY | SEQ ID NO: 3915 |
| ASSLRGVNTEAF | SEQ ID NO: 3916 |
| ASSQGRTEAF | SEQ ID NO: 3917 |
| ASSPTGANTEAF | SEQ ID NO: 3918 |
| ASSSGDYGYT | SEQ ID NO: 3919 |
| ASSPGGDYGYT | SEQ ID NO: 3920 |
| ASSLGTSGNEQF | SEQ ID NO: 3921 |
| ASSSQGDQPQH | SEQ ID NO: 3922 |
| ASSPRTGNQPQH | SEQ ID NO: 3923 |
| ASSLGVEQF | SEQ ID NO: 3924 |
| ASSLGTGDQPQH | SEQ ID NO: 3925 |
| ASSFQGTEAF | SEQ ID NO: 3926 |
| ASSDRGTEAF | SEQ ID NO: 3927 |
| ASSLRGEETQY | SEQ ID NO: 3928 |
| ASSLGQKNTEAF | SEQ ID NO: 3929 |
| ASSLDRDEQY | SEQ ID NO: 3930 |
| ASSYSNTGELF | SEQ ID NO: 3931 |
| ASSLSDTEAF | SEQ ID NO: 3932 |
| ASSASGSTDTQY | SEQ ID NO: 3933 |
| ASSFNYGYT | SEQ ID NO: 3934 |
| ASSPTGPYEQY | SEQ ID NO: 3935 |
| ASRTGTDTQY | SEQ ID NO: 3936 |
| ASSGQNYGYT | SEQ ID NO: 3937 |
| ASSSPGYEQY | SEQ ID NO: 3938 |
| ASRTYNEQF | SEQ ID NO: 3939 |
| ASSYGDTEAF | SEQ ID NO: 3940 |
| ASSLQGTGNTIY | SEQ ID NO: 3941 |
| ASSSQGLNTEAF | SEQ ID NO: 3942 |
| ASSERGNTEAF | SEQ ID NO: 3943 |
| ASSPDRSNQPQH | SEQ ID NO: 3944 |
| SARLAGGTDTQY | SEQ ID NO: 3945 |
| ASSLSGSTEAF | SEQ ID NO: 3946 |
| ASSLGSTGELF | SEQ ID NO: 3947 |
| ASSPRDSYNEQF | SEQ ID NO: 3948 |
| ASSPGGGYT | SEQ ID NO: 3949 |
| ASSQGNEQY | SEQ ID NO: 3950 |
| ASSRTGVNTEAF | SEQ ID NO: 3951 |
| ASSLTGENTEAF | SEQ ID NO: 3952 |
| ASSLERETQY | SEQ ID NO: 3953 |
| ASSLGGVTDTQY | SEQ ID NO: 3954 |
| ASSLASGSYNEQF | SEQ ID NO: 3955 |
| ASSSGTGNYGYT | SEQ ID NO: 3956 |
| ASSFENTEAF | SEQ ID NO: 3957 |
| ASSPRQGYEQY | SEQ ID NO: 3958 |
| ASSSGLYEQY | SEQ ID NO: 3959 |
| ASSLSGAYNEQF | SEQ ID NO: 3960 |
| ASSPGAYNEQF | SEQ ID NO: 3961 |
| ASSLGGVQETQY | SEQ ID NO: 3962 |
| ASSLTDYEQY | SEQ ID NO: 3963 |
| ASSLGEDTQY | SEQ ID NO: 3964 |
| ASSPPGSSYNEQF | SEQ ID NO: 3965 |
| ASSFRGSYNEQF | SEQ ID NO: 3966 |
| ASSGTLNTEAF | SEQ ID NO: 3967 |
| ASSFDTDTQY | SEQ ID NO: 3968 |
| ASSIGYEQY | SEQ ID NO: 3969 |
| ASSLAGDGYT | SEQ ID NO: 3970 |
| ASRGQPNTEAF | SEQ ID NO: 3971 |
| ASRDRAYEQY | SEQ ID NO: 3972 |
| ASSLARNQPQH | SEQ ID NO: 3973 |
| ASSSDGYEQY | SEQ ID NO: 3974 |
| ASSTGQGNTEAF | SEQ ID NO: 3975 |
| AISESYEQY | SEQ ID NO: 3976 |
| ASSLAPYNEQF | SEQ ID NO: 3977 |
| ASSLSGGADTQY | SEQ ID NO: 3978 |
| ASSWGLNTEAF | SEQ ID NO: 3979 |
| ASSRTAQETQY | SEQ ID NO: 3980 |

TABLE I-continued

| Sequence | Sequence ID No |
|---|---|
| ASSTSNQPQH | SEQ ID NO: 3981 |
| ASSPDRYNEQF | SEQ ID NO: 3982 |
| ATSRDRGYEQY | SEQ ID NO: 3983 |
| ASSFNQPQH | SEQ ID NO: 3984 |
| ASSDSSYNEQF | SEQ ID NO: 3985 |
| ASSLTENQPQH | SEQ ID NO: 3986 |
| ASSLGQTDTQY | SEQ ID NO: 3987 |
| ASSYSRGNTEAF | SEQ ID NO: 3988 |
| ASSLGLLNTEAF | SEQ ID NO: 3989 |
| ASSLGHNEQF | SEQ ID NO: 3990 |
| ASSVSDTQY | SEQ ID NO: 3991 |
| ASSFLSTDTQY | SEQ ID NO: 3992 |
| ASRITDTQY | SEQ ID NO: 3993 |
| ASSYTGGTEAF | SEQ ID NO: 3994 |
| ASSLGGNTDTQY | SEQ ID NO: 3995 |
| ASSPGTSGQETQY | SEQ ID NO: 3996 |
| ASSLDFTDTQY | SEQ ID NO: 3997 |
| ASSLDSQPQH | SEQ ID NO: 3998 |
| ASSQDGNTEAF | SEQ ID NO: 3999 |
| ASSYSTSTDTQY | SEQ ID NO: 4000 |

TABLE I-continued

| Sequence | Sequence ID No |
|---|---|
| ASSLRNSPLH | SEQ ID NO: 4001 |
| ASSAGGNTEAF | SEQ ID NO: 4002 |
| ASSLTGRETQY | SEQ ID NO: 4003 |
| ASSAYTDTQY | SEQ ID NO: 4004 |
| ASSLGQNTDTQY | SEQ ID NO: 4005 |
| ASSLGAGSYEQY | SEQ ID NO: 4006 |
| ASSQGGGYEQY | SEQ ID NO: 4007 |
| ASSLRTNTEAF | SEQ ID NO: 4008 |
| ASSLARSTDTQY | SEQ ID NO: 4009 |
| ASSSRDSSYEQY | SEQ ID NO: 4010 |
| ASSSGTGGNQPQH | SEQ ID NO: 4011 |
| ASSLWGQETQY | SEQ ID NO: 4012 |
| ASSRQGSGNTIY | SEQ ID NO: 4013 |
| ASSPYTEAF | SEQ ID NO: 4014 |

This application references various publications. The disclosures of these publications, in their entireties, are hereby incorporated by reference into this application to describe more fully the state of the art to which this application pertains. The references disclosed are also individually and specifically incorporated herein by reference for material contained within them that is discussed in the sentence in which the reference is relied on.

The methodologies and the various embodiments thereof described herein are exemplary. Various other embodiments of the methodologies described herein are possible.

SEQUENCE LISTING (4014 sequences)

SEQ ID NO: 1 - protein, 9 aa, Homo sapiens
ASSLGETQY

SEQ ID NO: 2 - protein, 10 aa, Homo sapiens
ASSLSTDTQY

SEQ ID NO: 3 - protein, 10 aa, Homo sapiens
ASSLGTDTQY

SEQ ID NO: 4 - protein, 10 aa, Homo sapiens
ASSPSTDTQY

SEQ ID NO: 5 - protein, 9 aa, Homo sapiens
ASSLQETQY

SEQ ID NO: 6 - protein, 9 aa, Homo sapiens
ASSLTDTQY

SEQ ID NO: 7 - protein, 9 aa, Homo sapiens
ASSLGYEQY

SEQ ID NO: 8 - protein, 9 aa, Homo sapiens
ASSLGDTQY

SEQ ID NO: 9 - protein, 11 aa, Homo sapiens
ASSLGGNTEAF

SEQ ID NO: 10 - protein, 11 aa, Homo sapiens
ASSLGGNQPQH

SEQ ID NO: 11 - protein, 9 aa, Homo sapiens
ASSLEETQY

SEQ ID NO: 12 - protein, 11 aa, Homo sapiens
ASSLDSNQPQH

SEQ ID NO: 13 - protein, 11 aa, Homo sapiens
ASSLGQNTEAF

SEQ ID NO: 14 - protein, 9 aa, Homo sapiens
ASSLRETQY

SEQ ID NO: 15 - protein, 9 aa, Homo sapiens
ASSLADTQY

SEQ ID NO: 16 - protein, 9 aa, Homo sapiens
ASSLSYEQY

SEQ ID NO: 17 - protein, 11 aa, Homo sapiens
ASSLGSNQPQH

SEQ ID NO: 18 - protein, 9 aa, Homo sapiens
ASSSSYEQY

SEQ ID NO: 19 - protein, 9 aa, Homo sapiens
ASSSQETQY

SEQ ID NO: 20 - protein, 9 aa, Homo sapiens
ASSPQETQY

SEQ ID NO: 21 - protein, 10 aa, Homo sapiens
ASSLGGTEAF

SEQ ID NO: 22 - protein, 9 aa, Homo sapiens
ASSSTDTQY

SEQ ID NO: 23 - protein, 11 aa, Homo sapiens
ASSLGGTDTQY

SEQ ID NO: 24 - protein, 11 aa, Homo sapiens
ASSLQGNTEAF

SEQ ID NO: 25 - protein, 12 aa, Homo sapiens
ASSLAGGTDTQY

SEQ ID NO: 26 - protein, 10 aa, Homo sapiens
ASSLGNTEAF

SEQ ID NO: 27 - protein, 9 aa, Homo sapiens
ASSFGETQY

SEQ ID NO: 28 - protein, 10 aa, Homo sapiens
ASSLGGYEQY

SEQ ID NO: 29 - protein, 11 aa, Homo sapiens
ASSLGLNTEAF

SEQ ID NO: 30 - protein, 11 aa, Homo sapiens
ASSLGSTDTQY

SEQ ID NO: 31 - protein, 11 aa, Homo sapiens
ASSLTGNTEAF

SEQ ID NO: 32 - protein, 11 aa, Homo sapiens
ASSLGRNTEAF

SEQ ID NO: 33 - protein, 9 aa, Homo sapiens
ASSPSYEQY

SEQ ID NO: 34 - protein, 10 aa, Homo sapiens
ASSPSSYEQY

SEQ ID NO: 35 - protein, 9 aa, Homo sapiens
ASSLYNEQF

SEQ ID NO: 36 - protein, 11 aa, Homo sapiens
ASSLGVNTEAF

SEQ ID NO: 37 - protein, 10 aa, Homo sapiens
ASSSSTDTQY

SEQ ID NO: 38 - protein, 11 aa, Homo sapiens
ASSLAGTDTQY

SEQ ID NO: 39 - protein, 9 aa, Homo sapiens
ASSFTDTQY

SEQ ID NO: 40 - protein, 11 aa, Homo sapiens
ASSLGQGYEQY

SEQ ID NO: 41 - protein, 9 aa, Homo sapiens
ASSLGNEQF

SEQ ID NO: 42 - protein, 9 aa, Homo sapiens
ASSLGTEAF

SEQ ID NO: 43 - protein, 10 aa, Homo sapiens
ASSPGTDTQY

SEQ ID NO: 44 - protein, 10 aa, Homo sapiens
ASSLSSYEQY

SEQ ID NO: 45 - protein, 10 aa, Homo sapiens
ASSLDSYEQY

SEQ ID NO: 46 - protein, 10 aa, Homo sapiens
ASSLGSYEQY

SEQ ID NO: 47 - protein, 11 aa, Homo sapiens
ASSLDRNTEAF

SEQ ID NO: 48 - protein, 9 aa, Homo sapiens
ASSLNTEAF

SEQ ID NO: 49 - protein, 9 aa, Homo sapiens
ASSSYNEQF

SEQ ID NO: 50 - protein, 9 aa, Homo sapiens
ASSPGETQY

SEQ ID NO: 51 - protein, 12 aa, Homo sapiens
ASSLGGSTDTQY

SEQ ID NO: 52 - protein, 10 aa, Homo sapiens
ASSLGGNEQF

SEQ ID NO: 53 - protein, 9 aa, Homo sapiens
ASSQGYEQY

SEQ ID NO: 54 - protein, 9 aa, Homo sapiens
ASSLSDTQY

SEQ ID NO: 55 - protein, 11 aa, Homo sapiens
ASSLTVNTEAF

SEQ ID NO: 56 - protein, 11 aa, Homo sapiens
ASSPPSTDTQY

SEQ ID NO: 57 - protein, 11 aa, Homo sapiens
ASSLAGNTEAF

SEQ ID NO: 58 - protein, 11 aa, Homo sapiens
ASSLGGSYEQY

SEQ ID NO: 59 - protein, 11 aa, Homo sapiens
ASSPGQGYEQY

SEQ ID NO: 60 - protein, 12 aa, Homo sapiens
ASSLGQGNTEAF

SEQ ID NO: 61 - protein, 12 aa, Homo sapiens
ASSLGGSNQPQH

SEQ ID NO: 62 - protein, 9 aa, Homo sapiens
ASSFQETQY

SEQ ID NO: 63 - protein, 10 aa, Homo sapiens
ASSLQGYEQY

SEQ ID NO: 64 - protein, 10 aa, Homo sapiens
ASSLGADTQY

SEQ ID NO: 65 - protein, 11 aa, Homo sapiens
ASSLTGGTEAF

SEQ ID NO: 66 - protein, 12 aa, Homo sapiens
ASSLGQGNQPQH

SEQ ID NO: 67 - protein, 11 aa, Homo sapiens
ASSLGSSYEQY

SEQ ID NO: 68 - protein, 11 aa, Homo sapiens
ASSLGSYNEQF

SEQ ID NO: 69 - protein, 12 aa, Homo sapiens
ASSLGGSSYEQY

SEQ ID NO: 70 - protein, 10 aa, Homo sapiens
ASSLAGYEQY

SEQ ID NO: 71 - protein, 12 aa, Homo sapiens
ASSLAGSTDTQY

SEQ ID NO: 72 - protein, 9 aa, Homo sapiens
ASSLKETQY

SEQ ID NO: 73 - protein, 11 aa, Homo sapiens
ASSLGGGTEAF

SEQ ID NO: 74 - protein, 11 aa, Homo sapiens
ASSRDSNQPQH

SEQ ID NO: 75 - protein, 11 aa, Homo sapiens
ASSLGPNTEAF

SEQ ID NO: 76 - protein, 10 aa, Homo sapiens
ASSLGGDTQY

SEQ ID NO: 77 - protein, 10 aa, Homo sapiens
ASSSSSYEQY

SEQ ID NO: 78 - protein, 10 aa, Homo sapiens
ASSLGNQPQH

SEQ ID NO: 79 - protein, 9 aa, Homo sapiens
ASSSTYEQY

SEQ ID NO: 80 - protein, 12 aa, Homo sapiens
ASSLGGGTDTQY

SEQ ID NO: 81 - protein, 11 aa, Homo sapiens
ASSLSSYNEQF

SEQ ID NO: 82 - protein, 10 aa, Homo sapiens
ASSFSTDTQY

SEQ ID NO: 83 - protein, 11 aa, Homo sapiens
ASSLGMNTEAF

SEQ ID NO: 84 - protein, 10 aa, Homo sapiens
ASSPDSYEQY

SEQ ID NO: 85 - protein, 9 aa, Homo sapiens
ASSPGYEQY

SEQ ID NO: 86 - protein, 10 aa, Homo sapiens
ASSPRTDTQY

SEQ ID NO: 87 - protein, 10 aa, Homo sapiens
ASSLDTDTQY

SEQ ID NO: 88 - protein, 10 aa, Homo sapiens
ASSLGGETQY

SEQ ID NO: 89 - protein, 9 aa, Homo sapiens
ASSRQETQY

SEQ ID NO: 90 - protein, 9 aa, Homo sapiens
ASSLAETQY

SEQ ID NO: 91 - protein, 12 aa, Homo sapiens
ASSLGQGAYEQY

SEQ ID NO: 92 - protein, 11 aa, Homo sapiens
ASSLNSNQPQH

SEQ ID NO: 93 - protein, 11 aa, Homo sapiens
ASSLQGNQPQH

SEQ ID NO: 94 - protein, 9 aa, Homo sapiens
ASSRTDTQY

SEQ ID NO: 95 - protein, 10 aa, Homo sapiens
ASSLNTGELF

SEQ ID NO: 96 - protein, 12 aa, Homo sapiens
ASSLGQGTDTQY

SEQ ID NO: 97 - protein, 11 aa, Homo sapiens
ASSLGQNYGYT

SEQ ID NO: 98 - protein, 11 aa, Homo sapiens
ASSLSGNTEAF

SEQ ID NO: 99 - protein, 11 aa, Homo sapiens
ASSLSSNQPQH

SEQ ID NO: 100 - protein, 11 aa, Homo sapiens
ASSLTGNQPQH

SEQ ID NO: 101 - protein, 10 aa, Homo sapiens
ASSPQGYEQY

SEQ ID NO: 102 - protein, 9 aa, Homo sapiens
ASSLSETQY

SEQ ID NO: 103 - protein, 9 aa, Homo sapiens
ASSLGGEQY

SEQ ID NO: 104 - protein, 10 aa, Homo sapiens
ASSLGYNEQF

SEQ ID NO: 105 - protein, 9 aa, Homo sapiens
ASSLRDTQY

SEQ ID NO: 106 - protein, 9 aa, Homo sapiens
ASSFSYEQY

SEQ ID NO: 107 - protein, 11 aa, Homo sapiens
ASSLRGNTEAF

SEQ ID NO: 108 - protein, 12 aa, Homo sapiens
ASSLGGSYNEQF

SEQ ID NO: 109 - protein, 11 aa, Homo sapiens
ASSPGQNTEAF

SEQ ID NO: 110 - protein, 12 aa, Homo sapiens
ASSLAGGYNEQF

SEQ ID NO: 111 - protein, 9 aa, Homo sapiens
ASSSGYEQY

SEQ ID NO: 112 - protein, 11 aa, Homo sapiens
ASSPTGNTEAF

SEQ ID NO: 113 - protein, 10 aa, Homo sapiens
ASSLGQETQY

SEQ ID NO: 114 - protein, 9 aa, Homo sapiens
ASSLAYEQY

SEQ ID NO: 115 - protein, 10 aa, Homo sapiens
ASSLSGYEQY

SEQ ID NO: 116 - protein, 9 aa, Homo sapiens
ASSLTYEQY

SEQ ID NO: 117 - protein, 11 aa, Homo sapiens
ASSLDSYNEQF

SEQ ID NO: 118 - protein, 11 aa, Homo sapiens
ASSLEGNQPQH

SEQ ID NO: 119 - protein, 11 aa, Homo sapiens
ASSLGQQETQY

SEQ ID NO: 120 - protein, 9 aa, Homo sapiens
ASSYTDTQY

SEQ ID NO: 121 - protein, 11 aa, Homo sapiens
ASSFGGNTEAF

SEQ ID NO: 122 - protein, 10 aa, Homo sapiens
ASSLVGYEQY

SEQ ID NO: 123 - protein, 9 aa, Homo sapiens
ASSPYNEQF

SEQ ID NO: 124 - protein, 11 aa, Homo sapiens
ASSLEGNTEAF

SEQ ID NO: 125 - protein, 11 aa, Homo sapiens
ASSLGGYNEQF

SEQ ID NO: 126 - protein, 11 aa, Homo sapiens
ASSLVGNTEAF

SEQ ID NO: 127 - protein, 10 aa, Homo sapiens
ASSLEGYEQY

SEQ ID NO: 128 - protein, 12 aa, Homo sapiens
ASSLGQLNTEAF

SEQ ID NO: 129 - protein, 9 aa, Homo sapiens
ASSPGDTQY

SEQ ID NO: 130 - protein, 11 aa, Homo sapiens
ASSLAGNQPQH

SEQ ID NO: 131 - protein, 9 aa, Homo sapiens
ASSSGETQY

SEQ ID NO: 132 - protein, 11 aa, Homo sapiens
ASSLGGQETQY

SEQ ID NO: 133 - protein, 10 aa, Homo sapiens
ASSPNTDTQY

SEQ ID NO: 134 - protein, 10 aa, Homo sapiens
ASSPGGTEAF

SEQ ID NO: 135 - protein, 9 aa, Homo sapiens
ASSLNYEQY

SEQ ID NO: 136 - protein, 10 aa, Homo sapiens
ASSSQGYEQY

SEQ ID NO: 137 - protein, 9 aa, Homo sapiens
ASSLVETQY

SEQ ID NO: 138 - protein, 11 aa, Homo sapiens
ASSLGENTEAF

SEQ ID NO: 139 - protein, 10 aa, Homo sapiens
ASSPGGYEQY

SEQ ID NO: 140 - protein, 11 aa, Homo sapiens
ASSLAGSYEQY

SEQ ID NO: 141 - protein, 11 aa, Homo sapiens
ASSLSGANVLT

SEQ ID NO: 142 - protein, 11 aa, Homo sapiens
ASSPQGNTEAF

SEQ ID NO: 143 - protein, 9 aa, Homo sapiens
ASSLLETQY

SEQ ID NO: 144 - protein, 9 aa, Homo sapiens
ASSRGYEQY

SEQ ID NO: 145 - protein, 10 aa, Homo sapiens
ASSLLNTEAF

SEQ ID NO: 146 - protein, 10 aa, Homo sapiens
ASSLGPYEQY

SEQ ID NO: 147 - protein, 9 aa, Homo sapiens
ASSYQETQY

SEQ ID NO: 148 - protein, 9 aa, Homo sapiens
ASSYSYEQY

SEQ ID NO: 149 - protein, 11 aa, Homo sapiens
ASSLAGGTEAF

SEQ ID NO: 150 - protein, 11 aa, Homo sapiens
ASSLQGTDTQY

SEQ ID NO: 151 - protein, 11 aa, Homo sapiens
ASSLRGTDTQY

SEQ ID NO: 152 - protein, 10 aa, Homo sapiens
ASSLNTDTQY

SEQ ID NO: 153 - protein, 11 aa, Homo sapiens
ASSLGANTEAF

SEQ ID NO: 154 - protein, 11 aa, Homo sapiens
ASSPGLNTEAF

SEQ ID NO: 155 - protein, 12 aa, Homo sapiens
ASSLGQGSYEQY

SEQ ID NO: 156 - protein, 9 aa, Homo sapiens
ASSFRETQY

SEQ ID NO: 157 - protein, 11 aa, Homo sapiens
ASSLTANTEAF

SEQ ID NO: 158 - protein, 9 aa, Homo sapiens
ASSLNNEQF

SEQ ID NO: 159 - protein, 9 aa, Homo sapiens
ASSFGDTQY

SEQ ID NO: 160 - protein, 11 aa, Homo sapiens
ASSRQGNTEAF

SEQ ID NO: 161 - protein, 11 aa, Homo sapiens
ASSLTENTEAF

SEQ ID NO: 162 - protein, 10 aa, Homo sapiens
ASSLTTDTQY

SEQ ID NO: 163 - protein, 11 aa, Homo sapiens
ASSRTGNTEAF

SEQ ID NO: 164 - protein, 10 aa, Homo sapiens
ASSLGGQPQH

SEQ ID NO: 165 - protein, 10 aa, Homo sapiens
ASSLTGYEQY

SEQ ID NO: 166 - protein, 9 aa, Homo sapiens
ASSQQETQY

SEQ ID NO: 167 - protein, 9 aa, Homo sapiens
ASSSAYEQY

SEQ ID NO: 168 - protein, 11 aa, Homo sapiens
ASSLDGNTEAF

SEQ ID NO: 169 - protein, 11 aa, Homo sapiens
ASSLGQSYEQY

SEQ ID NO: 170 - protein, 11 aa, Homo sapiens
ASSLAGGYEQY

SEQ ID NO: 171 - protein, 10 aa, Homo sapiens
ASSPTTDTQY

SEQ ID NO: 172 - protein, 11 aa, Homo sapiens
ASSPDRNTEAF

SEQ ID NO: 173 - protein, 13 aa, Homo sapiens
ASSLGGSSYNEQF

SEQ ID NO: 174 - protein, 10 aa, Homo sapiens
ASSLGGYGYT

SEQ ID NO: 175 - protein, 10 aa, Homo sapiens
ASSFGTDTQY

SEQ ID NO: 176 - protein, 11 aa, Homo sapiens
ASSLASTDTQY

SEQ ID NO: 177 - protein, 12 aa, Homo sapiens
ASSLGQSTDTQY

SEQ ID NO: 178 - protein, 10 aa, Homo sapiens
ASSRSTDTQY

SEQ ID NO: 179 - protein, 11 aa, Homo sapiens
ASSLDSTDTQY

SEQ ID NO: 180 - protein, 11 aa, Homo sapiens
ASSSQGNTEAF

SEQ ID NO: 181 - protein, 9 aa, Homo sapiens
ASSFGYEQY

SEQ ID NO: 182 - protein, 12 aa, Homo sapiens
ASSLGTANTEAF

SEQ ID NO: 183 - protein, 9 aa, Homo sapiens
ASSSPYEQY

SEQ ID NO: 184 - protein, 11 aa, Homo sapiens
ASSLAGQETQY

SEQ ID NO: 185 - protein, 10 aa, Homo sapiens
ASSLSNQPQH

SEQ ID NO: 186 - protein, 11 aa, Homo sapiens
ASSLVGTDTQY

SEQ ID NO: 187 - protein, 10 aa, Homo sapiens
ASSLVTDTQY

SEQ ID NO: 188 - protein, 10 aa, Homo sapiens
ASSLSGNTIY

SEQ ID NO: 189 - protein, 12 aa, Homo sapiens
ASSLGGGNQPQH

SEQ ID NO: 190 - protein, 10 aa, Homo sapiens
ASSLRTDTQY

SEQ ID NO: 191 - protein, 12 aa, Homo sapiens
ASSPGQGNQPQH

SEQ ID NO: 192 - protein, 10 aa, Homo sapiens
ASSLMNTEAF

SEQ ID NO: 193 - protein, 12 aa, Homo sapiens
ASSLSGSTDTQY

SEQ ID NO: 194 - protein, 9 aa, Homo sapiens
ASSPRETQY

SEQ ID NO: 195 - protein, 11 aa, Homo sapiens
ASSPDSNQPQH

SEQ ID NO: 196 - protein, 10 aa, Homo sapiens
ASSSYTDTQY

SEQ ID NO: 197 - protein, 11 aa, Homo sapiens
ASSLTSTDTQY

SEQ ID NO: 198 - protein, 12 aa, Homo sapiens
ASSPGQGNTEAF

SEQ ID NO: 199 - protein, 12 aa, Homo sapiens
ASSPGQGAYEQY

SEQ ID NO: 200 - protein, 9 aa, Homo sapiens
ASSRNTEAF

SEQ ID NO: 201 - protein, 9 aa, Homo sapiens
ASSQSYEQY

SEQ ID NO: 202 - protein, 10 aa, Homo sapiens
ASSSGTDTQY

SEQ ID NO: 203 - protein, 11 aa, Homo sapiens
ASSLGQGYGYT

SEQ ID NO: 204 - protein, 9 aa, Homo sapiens
ASSQGETQY

SEQ ID NO: 205 - protein, 12 aa, Homo sapiens
ASSPGQGTDTQY

SEQ ID NO: 206 - protein, 10 aa, Homo sapiens
ASSYSTDTQY

SEQ ID NO: 207 - protein, 12 aa, Homo sapiens
ASSLGQMNTEAF

SEQ ID NO: 208 - protein, 11 aa, Homo sapiens
ASSLQGGTEAF

SEQ ID NO: 209 - protein, 10 aa, Homo sapiens
ASSLVGETQY

SEQ ID NO: 210 - protein, 12 aa, Homo sapiens
ASSLAGSYNEQF

SEQ ID NO: 211 - protein, 10 aa, Homo sapiens
ASSRDSYEQY

SEQ ID NO: 212 - protein, 11 aa, Homo sapiens
ASSRDSQETQY

SEQ ID NO: 213 - protein, 9 aa, Homo sapiens
ASSLDYEQY

SEQ ID NO: 214 - protein, 11 aa, Homo sapiens
ASSLDGNQPQH

SEQ ID NO: 215 - protein, 9 aa, Homo sapiens
ASSRYNEQF

SEQ ID NO: 216 - protein, 11 aa, Homo sapiens
ASSLGLQETQY

SEQ ID NO: 217 - protein, 9 aa, Homo sapiens
ASSFSDTQY

SEQ ID NO: 218 - protein, 12 aa, Homo sapiens
ASSPGTGSYEQY

SEQ ID NO: 219 - protein, 11 aa, Homo sapiens
ASSLSGNQPQH

SEQ ID NO: 220 - protein, 9 aa, Homo sapiens
ASSDSYEQY

SEQ ID NO: 221 - protein, 10 aa, Homo sapiens
ASSLGDTEAF

SEQ ID NO: 222 - protein, 10 aa, Homo sapiens
ASSLAGDTQY

SEQ ID NO: 223 - protein, 9 aa, Homo sapiens
ASSRSYEQY

SEQ ID NO: 224 - protein, 10 aa, Homo sapiens
ASSLVGNEQF

SEQ ID NO: 225 - protein, 11 aa, Homo sapiens
ASSLGQTYEQY

SEQ ID NO: 226 - protein, 11 aa, Homo sapiens
ASSPGGTDTQY

SEQ ID NO: 227 - protein, 12 aa, Homo sapiens
ASSPGQGSYEQY

SEQ ID NO: 228 - protein, 10 aa, Homo sapiens
ASSLAGETQY

SEQ ID NO: 229 - protein, 10 aa, Homo sapiens
ASSLRGTEAF

SEQ ID NO: 230 - protein, 10 aa, Homo sapiens
ASSPGSYEQY

SEQ ID NO: 231 - protein, 11 aa, Homo sapiens
ASSLSRNTEAF

SEQ ID NO: 232 - protein, 11 aa, Homo sapiens
ASSPGQQETQY

SEQ ID NO: 233 - protein, 10 aa, Homo sapiens
ASSLGTGELF

SEQ ID NO: 234 - protein, 9 aa, Homo sapiens
ASSLGGEQF

SEQ ID NO: 235 - protein, 11 aa, Homo sapiens
ASSLYSNQPQH

SEQ ID NO: 236 - protein, 9 aa, Homo sapiens
ASSPTDTQY

SEQ ID NO: 237 - protein, 10 aa, Homo sapiens
ASSLAGNEQF

SEQ ID NO: 238 - protein, 12 aa, Homo sapiens
ASSPGTGGYEQY

SEQ ID NO: 239 - protein, 10 aa, Homo sapiens
ASSLATDTQY

SEQ ID NO: 240 - protein, 11 aa, Homo sapiens
ASSRDSSYEQY

SEQ ID NO: 241 - protein, 12 aa, Homo sapiens
ASSPGTANTEAF

SEQ ID NO: 242 - protein, 10 aa, Homo sapiens
ASSLGPDTQY

SEQ ID NO: 243 - protein, 11 aa, Homo sapiens
ASSLAVNTEAF

SEQ ID NO: 244 - protein, 9 aa, Homo sapiens
ASSLEDTQY

SEQ ID NO: 245 - protein, 11 aa, Homo sapiens
ASSLGGADTQY

SEQ ID NO: 246 - protein, 12 aa, Homo sapiens
ASSLGSSYNEQF

SEQ ID NO: 247 - protein, 12 aa, Homo sapiens
ASSLAGGSYEQY

SEQ ID NO: 248 - protein, 11 aa, Homo sapiens
ASSRDRNTEAF

SEQ ID NO: 249 - protein, 10 aa, Homo sapiens
ASSSDSYEQY

SEQ ID NO: 250 - protein, 11 aa, Homo sapiens
ASSLEVNTEAF

SEQ ID NO: 251 - protein, 13 aa, Homo sapiens
ASSLSGSSYNEQF

SEQ ID NO: 252 - protein, 11 aa, Homo sapiens
ASSLSSTDTQY

SEQ ID NO: 253 - protein, 12 aa, Homo sapiens
ASSLGTSTDTQY

SEQ ID NO: 254 - protein, 12 aa, Homo sapiens
ASSLGTGSYEQY

SEQ ID NO: 255 - protein, 10 aa, Homo sapiens
ASSLVADTQY

SEQ ID NO: 256 - protein, 10 aa, Homo sapiens
ASSLSYNEQF

SEQ ID NO: 257 - protein, 12 aa, Homo sapiens
ASSLGGMNTEAF

SEQ ID NO: 258 - protein, 10 aa, Homo sapiens
ASSSGSYEQY

SEQ ID NO: 259 - protein, 10 aa, Homo sapiens
ASSLDGYEQY

SEQ ID NO: 260 - protein, 11 aa, Homo sapiens
ASSLSGTDTQY

SEQ ID NO: 261 - protein, 10 aa, Homo sapiens
ASSLGSDTQY

SEQ ID NO: 262 - protein, 11 aa, Homo sapiens
ASSQGLNTEAF

SEQ ID NO: 263 - protein, 9 aa, Homo sapiens
ASSLVDTQY

SEQ ID NO: 264 - protein, 10 aa, Homo sapiens
ASSLGAYEQY

SEQ ID NO: 265 - protein, 11 aa, Homo sapiens
ASSLDRNQPQH

SEQ ID NO: 266 - protein, 10 aa, Homo sapiens
ASSLGTYEQY

SEQ ID NO: 267 - protein, 10 aa, Homo sapiens
ASSLVNTEAF

SEQ ID NO: 268 - protein, 11 aa, Homo sapiens
ASSLSVNTEAF

SEQ ID NO: 269 - protein, 9 aa, Homo sapiens
ASSAQETQY

SEQ ID NO: 270 - protein, 9 aa, Homo sapiens
ASSLVNEQF

SEQ ID NO: 271 - protein, 10 aa, Homo sapiens
ASSLRGYEQY

SEQ ID NO: 272 - protein, 12 aa, Homo sapiens
ASSLTGGNTEAF

SEQ ID NO: 273 - protein, 11 aa, Homo sapiens
ASSLDSSYEQY

SEQ ID NO: 274 - protein, 11 aa, Homo sapiens
ASSLAGADTQY

SEQ ID NO: 275 - protein, 12 aa, Homo sapiens
ASSLAGGPYEQY

SEQ ID NO: 276 - protein, 12 aa, Homo sapiens
ASSPGTGNQPQH

SEQ ID NO: 277 - protein, 11 aa, Homo sapiens
ASSPGLQETQY

SEQ ID NO: 278 - protein, 10 aa, Homo sapiens
ASSTSTDTQY

SEQ ID NO: 279 - protein, 12 aa, Homo sapiens
ASSLDRGTDTQY

SEQ ID NO: 280 - protein, 11 aa, Homo sapiens
ASSLQENTEAF

SEQ ID NO: 281 - protein, 9 aa, Homo sapiens
ASSSLYEQY

SEQ ID NO: 282 - protein, 10 aa, Homo sapiens
ASSPGNTEAF

SEQ ID NO: 283 - protein, 11 aa, Homo sapiens
ASSQDSNQPQH

SEQ ID NO: 284 - protein, 11 aa, Homo sapiens
ASSLTGSYEQY

SEQ ID NO: 285 - protein, 12 aa, Homo sapiens
ASSLAGSSYEQY

SEQ ID NO: 286 - protein, 11 aa, Homo sapiens
ASSFGSNQPQH

SEQ ID NO: 287 - protein, 12 aa, Homo sapiens
ASSLGGSGNTIY

SEQ ID NO: 288 - protein, 11 aa, Homo sapiens
ASSLSLNTEAF

SEQ ID NO: 289 - protein, 9 aa, Homo sapiens
ASSNTDTQY

SEQ ID NO: 290 - protein, 11 aa, Homo sapiens
ASSRTVNTEAF

SEQ ID NO: 291 - protein, 9 aa, Homo sapiens
ASSPAYEQY

SEQ ID NO: 292 - protein, 11 aa, Homo sapiens
ASSPTVNTEAF

SEQ ID NO: 293 - protein, 9 aa, Homo sapiens
ASSRGETQY

SEQ ID NO: 294 - protein, 10 aa, Homo sapiens
ASSLVGTEAF

SEQ ID NO: 295 - protein, 11 aa, Homo sapiens
ASSRDRQETQY

SEQ ID NO: 296 - protein, 12 aa, Homo sapiens
ASSLGGLNTEAF

SEQ ID NO: 297 - protein, 10 aa, Homo sapiens
ASSFGGTEAF

SEQ ID NO: 298 - protein, 8 aa, Homo sapiens
ASSQETQY

SEQ ID NO: 299 - protein, 11 aa, Homo sapiens
ASSLSGSYEQY

SEQ ID NO: 300 - protein, 9 aa, Homo sapiens
ASSPEETQY

SEQ ID NO: 301 - protein, 11 aa, Homo sapiens
ASSPGGNTEAF

SEQ ID NO: 302 - protein, 9 aa, Homo sapiens
ASSLLDTQY

SEQ ID NO: 303 - protein, 10 aa, Homo sapiens
ASSLLTDTQY

SEQ ID NO: 304 - protein, 9 aa, Homo sapiens
ASSSYYEQY

SEQ ID NO: 305 - protein, 10 aa, Homo sapiens
ASSQSTDTQY

SEQ ID NO: 306 - protein, 10 aa, Homo sapiens
ASSFGNTEAF

SEQ ID NO: 307 - protein, 11 aa, Homo sapiens
ASSLTGDTEAF

SEQ ID NO: 308 - protein, 11 aa, Homo sapiens
ASSPSSYNEQF

SEQ ID NO: 309 - protein, 11 aa, Homo sapiens
ASSFGGTDTQY

SEQ ID NO: 310 - protein, 11 aa, Homo sapiens
ASSSDRNTEAF

SEQ ID NO: 311 - protein, 11 aa, Homo sapiens
ASSQDRNTEAF

SEQ ID NO: 312 - protein, 11 aa, Homo sapiens
ASSLGLYNEQF

SEQ ID NO: 313 - protein, 12 aa, Homo sapiens
ASSLTGGNQPQH

SEQ ID NO: 314 - protein, 11 aa, Homo sapiens
ASSLGGNYGYT

SEQ ID NO: 315 - protein, 10 aa, Homo sapiens
ASSPPTDTQY

SEQ ID NO: 316 - protein, 12 aa, Homo sapiens
ASSLAGGQETQY

SEQ ID NO: 317 - protein, 11 aa, Homo sapiens
ASSLTGTDTQY

SEQ ID NO: 318 - protein, 11 aa, Homo sapiens
ASSLGQAYEQY

SEQ ID NO: 319 - protein, 11 aa, Homo sapiens
ASSRDSTDTQY

SEQ ID NO: 320 - protein, 10 aa, Homo sapiens
ASSPTGYEQY

SEQ ID NO: 321 - protein, 12 aa, Homo sapiens
ASSLQGSNQPQH

SEQ ID NO: 322 - protein, 12 aa, Homo sapiens
ASSLTGGTDTQY

SEQ ID NO: 323 - protein, 9 aa, Homo sapiens
ASSYGETQY

SEQ ID NO: 324 - protein, 10 aa, Homo sapiens
ASSPYTDTQY

SEQ ID NO: 325 - protein, 11 aa, Homo sapiens
ASSLDLNTEAF

SEQ ID NO: 326 - protein, 12 aa, Homo sapiens
ASSLTGSNQPQH

SEQ ID NO: 327 - protein, 9 aa, Homo sapiens
ASSLSNEQF

SEQ ID NO: 328 - protein, 11 aa, Homo sapiens
ASSLGTNTEAF

SEQ ID NO: 329 - protein, 10 aa, Homo sapiens
ASSPGADTQY

SEQ ID NO: 330 - protein, 11 aa, Homo sapiens
ASSLTGNYGYT

SEQ ID NO: 331 - protein, 12 aa, Homo sapiens
ASSLAGSNQPQH

SEQ ID NO: 332 - protein, 11 aa, Homo sapiens
ASSSTGNTEAF

SEQ ID NO: 333 - protein, 12 aa, Homo sapiens
ASSLSGGTDTQY

SEQ ID NO: 334 - protein, 9 aa, Homo sapiens
ASSPNTEAF

SEQ ID NO: 335 - protein, 9 aa, Homo sapiens
ASSLGYGYT

SEQ ID NO: 336 - protein, 12 aa, Homo sapiens
ASSLAGGNTEAF

SEQ ID NO: 337 - protein, 11 aa, Homo sapiens
ASSQGGNTEAF

SEQ ID NO: 338 - protein, 11 aa, Homo sapiens
ASSRDRGYEQY

SEQ ID NO: 339 - protein, 10 aa, Homo sapiens
ASSRGTDTQY

SEQ ID NO: 340 - protein, 10 aa, Homo sapiens
ASSLRNTEAF

SEQ ID NO: 341 - protein, 9 aa, Homo sapiens
ASSSRETQY

SEQ ID NO: 342 - protein, 9 aa, Homo sapiens
ASSLGQPQH

SEQ ID NO: 343 - protein, 10 aa, Homo sapiens
ASSLVGDTQY

SEQ ID NO: 344 - protein, 9 aa, Homo sapiens
ASSLTETQY

SEQ ID NO: 345 - protein, 12 aa, Homo sapiens
ASSLGTVNTEAF

SEQ ID NO: 346 - protein, 10 aa, Homo sapiens
ASSQGTDTQY

SEQ ID NO: 347 - protein, 9 aa, Homo sapiens
ASSFYNEQF

SEQ ID NO: 348 - protein, 11 aa, Homo sapiens
ASSSGSTDTQY

SEQ ID NO: 349 - protein, 9 aa, Homo sapiens
ASSLDTEAF

SEQ ID NO: 350 - protein, 11 aa, Homo sapiens
ASSLEGGTEAF

SEQ ID NO: 351 - protein, 12 aa, Homo sapiens
ASSLGLSTDTQY

SEQ ID NO: 352 - protein, 10 aa, Homo sapiens
ASSLGDQPQH

SEQ ID NO: 353 - protein, 11 aa, Homo sapiens
ASSLRENTEAF

SEQ ID NO: 354 - protein, 11 aa, Homo sapiens
ASSLALNTEAF

SEQ ID NO: 355 - protein, 9 aa, Homo sapiens
ASSVTDTQY

SEQ ID NO: 356 - protein, 10 aa, Homo sapiens
ASSLDQETQY

SEQ ID NO: 357 - protein, 12 aa, Homo sapiens
ASSLSGSSYEQY

SEQ ID NO: 358 - protein, 9 aa, Homo sapiens
ASSPKETQY

SEQ ID NO: 359 - protein, 10 aa, Homo sapiens
ASSLSQETQY

SEQ ID NO: 360 - protein, 10 aa, Homo sapiens
ASSLAQETQY

SEQ ID NO: 361 - protein, 10 aa, Homo sapiens
ASSLQNTEAF

SEQ ID NO: 362 - protein, 9 aa, Homo sapiens
ASSLRNEQF

SEQ ID NO: 363 - protein, 11 aa, Homo sapiens
ASSLSGGTEAF

SEQ ID NO: 364 - protein, 10 aa, Homo sapiens
ASSPGGETQY

SEQ ID NO: 365 - protein, 11 aa, Homo sapiens
ASSRDSYNEQF

SEQ ID NO: 366 - protein, 10 aa, Homo sapiens
ASSSSYNEQF

SEQ ID NO: 367 - protein, 10 aa, Homo sapiens
ASSRQGYEQY

SEQ ID NO: 368 - protein, 11 aa, Homo sapiens
ASSLAENTEAF

SEQ ID NO: 369 - protein, 10 aa, Homo sapiens
ASSLYTDTQY

SEQ ID NO: 370 - protein, 11 aa, Homo sapiens
ASSLGQYNEQF

SEQ ID NO: 371 - protein, 11 aa, Homo sapiens
ASSLTLNTEAF

SEQ ID NO: 372 - protein, 11 aa, Homo sapiens
ASSLAGAYEQY

SEQ ID NO: 373 - protein, 12 aa, Homo sapiens
ASSLGGGNTEAF

SEQ ID NO: 374 - protein, 11 aa, Homo sapiens
ASSLQVNTEAF

SEQ ID NO: 375 - protein, 13 aa, Homo sapiens
ASSLAGSSYNEQF

SEQ ID NO: 376 - protein, 11 aa, Homo sapiens
ASSLRGNQPQH

SEQ ID NO: 377 - protein, 11 aa, Homo sapiens
ASSLDRGYEQY

SEQ ID NO: 378 - protein, 11 aa, Homo sapiens
ASSPPGTDTQY

SEQ ID NO: 379 - protein, 12 aa, Homo sapiens
ASSLGTGNQPQH

SEQ ID NO: 380 - protein, 10 aa, Homo sapiens
ASSSRTDTQY

SEQ ID NO: 381 - protein, 11 aa, Homo sapiens
ASSLRVNTEAF

SEQ ID NO: 382 - protein, 13 aa, Homo sapiens
ASSLAGGSYNEQF

SEQ ID NO: 383 - protein, 12 aa, Homo sapiens
ASSPGTGAYEQY

SEQ ID NO: 384 - protein, 11 aa, Homo sapiens
ASSPGSNQPQH

SEQ ID NO: 385 - protein, 10 aa, Homo sapiens
ASSPNTGELF

SEQ ID NO: 386 - protein, 11 aa, Homo sapiens
ASSPGRNTEAF

SEQ ID NO: 387 - protein, 9 aa, Homo sapiens
ASSLTGELF

SEQ ID NO: 388 - protein, 11 aa, Homo sapiens
ASSPDRNYGYT

SEQ ID NO: 389 - protein, 12 aa, Homo sapiens
ASSPGTVNTEAF

SEQ ID NO: 390 - protein, 11 aa, Homo sapiens
ASSLAGGNEQF

SEQ ID NO: 391 - protein, 10 aa, Homo sapiens
ASSQGGTEAF

SEQ ID NO: 392 - protein, 11 aa, Homo sapiens
ASSLDRNYGYT

SEQ ID NO: 393 - protein, 9 aa, Homo sapiens
ASSIQETQY

SEQ ID NO: 394 - protein, 11 aa, Homo sapiens
ASSLGRSYEQY

SEQ ID NO: 395 - protein, 10 aa, Homo sapiens
ASSRGNTEAF

SEQ ID NO: 396 - protein, 10 aa, Homo sapiens
ASSLSGETQY

SEQ ID NO: 397 - protein, 9 aa, Homo sapiens
ASSLDNEQF

SEQ ID NO: 398 - protein, 11 aa, Homo sapiens
ASSSGQNTEAF

SEQ ID NO: 399 - protein, 11 aa, Homo sapiens
ASSPGQGYGYT

SEQ ID NO: 400 - protein, 10 aa, Homo sapiens
ASSPDTDTQY

SEQ ID NO: 401 - protein, 9 aa, Homo sapiens
ASSSGDTQY

SEQ ID NO: 402 - protein, 11 aa, Homo sapiens
ASSPGSTDTQY

SEQ ID NO: 403 - protein, 11 aa, Homo sapiens
ASSPGSSYEQY

SEQ ID NO: 404 - protein, 11 aa, Homo sapiens
ASSLGGGYEQY

SEQ ID NO: 405 - protein, 11 aa, Homo sapiens
ASSLDRGTEAF

SEQ ID NO: 406 - protein, 10 aa, Homo sapiens
ASSGSTDTQY

SEQ ID NO: 407 - protein, 9 aa, Homo sapiens
ASRLNTEAF

SEQ ID NO: 408 - protein, 11 aa, Homo sapiens
ASSLEGTDTQY

SEQ ID NO: 409 - protein, 10 aa, Homo sapiens
ASSQGNTEAF

SEQ ID NO: 410 - protein, 12 aa, Homo sapiens
ASSLAGGNQPQH

SEQ ID NO: 411 - protein, 11 aa, Homo sapiens
ASSLGRTDTQY

SEQ ID NO: 412 - protein, 12 aa, Homo sapiens
ASSLGRSTDTQY

SEQ ID NO: 413 - protein, 10 aa, Homo sapiens
ASSLRGNEQF

SEQ ID NO: 414 - protein, 11 aa, Homo sapiens
ASSPGGNQPQH

SEQ ID NO: 415 - protein, 11 aa, Homo sapiens
ASSLLGNTEAF

SEQ ID NO: 416 - protein, 11 aa, Homo sapiens
ASSPGQNYGYT

SEQ ID NO: 417 - protein, 9 aa, Homo sapiens
ASSTTDTQY

SEQ ID NO: 418 - protein, 9 aa, Homo sapiens
ASSQGDTQY

SEQ ID NO: 419 - protein, 11 aa, Homo sapiens
ASSLGGDQPQH

SEQ ID NO: 420 - protein, 11 aa, Homo sapiens
ASSLGTAYEQY

SEQ ID NO: 421 - protein, 11 aa, Homo sapiens
ASSLGTYNEQF

SEQ ID NO: 422 - protein, 9 aa, Homo sapiens
ASSTQETQY

SEQ ID NO: 423 - protein, 11 aa, Homo sapiens
ASSLGPQETQY

SEQ ID NO: 424 - protein, 10 aa, Homo sapiens
ASSQDRETQY

SEQ ID NO: 425 - protein, 10 aa, Homo sapiens
ASSLAADTQY

SEQ ID NO: 426 - protein, 10 aa, Homo sapiens
ASSLLGNEQF

SEQ ID NO: 427 - protein, 11 aa, Homo sapiens
ASSLGQGTEAF

SEQ ID NO: 428 - protein, 11 aa, Homo sapiens
ASSPGQSYEQY

SEQ ID NO: 429 - protein, 9 aa, Homo sapiens
ASSVQETQY

SEQ ID NO: 430 - protein, 10 aa, Homo sapiens
ASSPNQETQY

SEQ ID NO: 431 - protein, 10 aa, Homo sapiens
ASSFSNQPQH

SEQ ID NO: 432 - protein, 11 aa, Homo sapiens
ASSLGRNQPQH

SEQ ID NO: 433 - protein, 9 aa, Homo sapiens
ASSRGTEAF

SEQ ID NO: 434 - protein, 11 aa, Homo sapiens
ASSFGQNTEAF

SEQ ID NO: 435 - protein, 11 aa, Homo sapiens
ASSLGGDTEAF

SEQ ID NO: 436 - protein, 12 aa, Homo sapiens
ASSPTGGNQPQH

SEQ ID NO: 437 - protein, 11 aa, Homo sapiens
ASSLGSNTEAF

SEQ ID NO: 438 - protein, 11 aa, Homo sapiens
ASSPGTAYEQY

SEQ ID NO: 439 - protein, 10 aa, Homo sapiens
ASSPYQETQY

SEQ ID NO: 440 - protein, 11 aa, Homo sapiens
ASSLGGTYEQY

SEQ ID NO: 441 - protein, 12 aa, Homo sapiens
ASSLGLATDTQY

SEQ ID NO: 442 - protein, 11 aa, Homo sapiens
ASSQGRNTEAF

SEQ ID NO: 443 - protein, 11 aa, Homo sapiens
ASSPTGNYGYT

SEQ ID NO: 444 - protein, 11 aa, Homo sapiens
ASSGQGNTEAF

SEQ ID NO: 445 - protein, 11 aa, Homo sapiens
ASSRTENTEAF

SEQ ID NO: 446 - protein, 9 aa, Homo sapiens
ASSLRYEQY

SEQ ID NO: 447 - protein, 11 aa, Homo sapiens
ASSQGSNQPQH

SEQ ID NO: 448 - protein, 11 aa, Homo sapiens
ASSLARNTEAF

SEQ ID NO: 449 - protein, 11 aa, Homo sapiens
ASSLAGYNEQF

SEQ ID NO: 450 - protein, 9 aa, Homo sapiens
ASSLLNEQF

SEQ ID NO: 451 - protein, 10 aa, Homo sapiens
ASSPLTDTQY

SEQ ID NO: 452 - protein, 11 aa, Homo sapiens
ASSLGSGNTIY

SEQ ID NO: 453 - protein, 9 aa, Homo sapiens
ASSRGDTQY

SEQ ID NO: 454 - protein, 9 aa, Homo sapiens
ASSASYEQY

SEQ ID NO: 455 - protein, 10 aa, Homo sapiens
ASSLEGYGYT

SEQ ID NO: 456 - protein, 11 aa, Homo sapiens
ASSFQGNTEAF

SEQ ID NO: 457 - protein, 9 aa, Homo sapiens
ASSSNTEAF

SEQ ID NO: 458 - protein, 12 aa, Homo sapiens
ASSLTGMNTEAF

SEQ ID NO: 459 - protein, 12 aa, Homo sapiens
ASSLGTGNTEAF

SEQ ID NO: 460 - protein, 12 aa, Homo sapiens
ASSFGGSTDTQY

SEQ ID NO: 461 - protein, 10 aa, Homo sapiens
ASSFSSYEQY

SEQ ID NO: 462 - protein, 11 aa, Homo sapiens
ASSFGGNQPQH

SEQ ID NO: 463 - protein, 10 aa, Homo sapiens
ASSLSGNEQF

SEQ ID NO: 464 - protein, 9 aa, Homo sapiens
ASSQYNEQF

SEQ ID NO: 465 - protein, 11 aa, Homo sapiens
ASSLRSTDTQY

SEQ ID NO: 466 - protein, 9 aa, Homo sapiens
ASSLGGTQY

SEQ ID NO: 467 - protein, 12 aa, Homo sapiens
ASSLGASTDTQY

SEQ ID NO: 468 - protein, 11 aa, Homo sapiens
ASSLAGEETQY

SEQ ID NO: 469 - protein, 10 aa, Homo sapiens
ASSFGNQPQH

SEQ ID NO: 470 - protein, 12 aa, Homo sapiens
ASSLTGLNTEAF

SEQ ID NO: 471 - protein, 11 aa, Homo sapiens
ASSLGSQETQY

SEQ ID NO: 472 - protein, 10 aa, Homo sapiens
ASSLSGDTQY

SEQ ID NO: 473 - protein, 12 aa, Homo sapiens
ASSLTGSTDTQY

SEQ ID NO: 474 - protein, 10 aa, Homo sapiens
ASSSGNQPQH

SEQ ID NO: 475 - protein, 10 aa, Homo sapiens
ASSSSNQPQH

SEQ ID NO: 476 - protein, 9 aa, Homo sapiens
ASSGYNEQF

SEQ ID NO: 477 - protein, 10 aa, Homo sapiens
ASSLARETQY

SEQ ID NO: 478 - protein, 10 aa, Homo sapiens
ASSLVSYEQY

SEQ ID NO: 479 - protein, 12 aa, Homo sapiens
ASSLAGGPDTQY

SEQ ID NO: 480 - protein, 12 aa, Homo sapiens
ASSLTSGTDTQY

SEQ ID NO: 481 - protein, 10 aa, Homo sapiens
ASSLGRETQY

SEQ ID NO: 482 - protein, 12 aa, Homo sapiens
ASSLGQGGTEAF

SEQ ID NO: 483 - protein, 10 aa, Homo sapiens
ASSLSADTQY

SEQ ID NO: 484 - protein, 11 aa, Homo sapiens
ASSSGQGYEQY

SEQ ID NO: 485 - protein, 10 aa, Homo sapiens
ASSLTSYEQY

SEQ ID NO: 486 - protein, 11 aa, Homo sapiens
ASSLAGGETQY

SEQ ID NO: 487 - protein, 9 aa, Homo sapiens
ASSFADTQY

SEQ ID NO: 488 - protein, 11 aa, Homo sapiens
ASSFGRNTEAF

SEQ ID NO: 489 - protein, 12 aa, Homo sapiens
ASSFSGSTDTQY

SEQ ID NO: 490 - protein, 10 aa, Homo sapiens
ASSLVQETQY

SEQ ID NO: 491 - protein, 9 aa, Homo sapiens
ASSHTDTQY

SEQ ID NO: 492 - protein, 11 aa, Homo sapiens
ASSFGSTDTQY

SEQ ID NO: 493 - protein, 11 aa, Homo sapiens
ASSPRGNTEAF

SEQ ID NO: 494 - protein, 12 aa, Homo sapiens
ASSSGQGTDTQY

SEQ ID NO: 495 - protein, 11 aa, Homo sapiens
ASSLGRQETQY

SEQ ID NO: 496 - protein, 11 aa, Homo sapiens
ASSGQGNQPQH

SEQ ID NO: 497 - protein, 11 aa, Homo sapiens
ASSLVSTDTQY

SEQ ID NO: 498 - protein, 9 aa, Homo sapiens
ASSSNYEQY

SEQ ID NO: 499 - protein, 9 aa, Homo sapiens
ASSQAYEQY

SEQ ID NO: 500 - protein, 11 aa, Homo sapiens
ASSLGPNQPQH

SEQ ID NO: 501 - protein, 11 aa, Homo sapiens
ASSLQGSYEQY

SEQ ID NO: 502 - protein, 9 aa, Homo sapiens
ASSPGTEAF

SEQ ID NO: 503 - protein, 11 aa, Homo sapiens
ASSSSSYNEQF

SEQ ID NO: 504 - protein, 10 aa, Homo sapiens
ASSASTDTQY

SEQ ID NO: 505 - protein, 12 aa, Homo sapiens
ASSLGPSTDTQY

SEQ ID NO: 506 - protein, 10 aa, Homo sapiens
ASSLDSYGYT

SEQ ID NO: 507 - protein, 10 aa, Homo sapiens
ASSLRGDTQY

SEQ ID NO: 508 - protein, 11 aa, Homo sapiens
ASSFGSSYEQY

SEQ ID NO: 509 - protein, 9 aa, Homo sapiens
ASSHSYEQY

SEQ ID NO: 510 - protein, 10 aa, Homo sapiens
ASSQGSYEQY

SEQ ID NO: 511 - protein, 10 aa, Homo sapiens
ASSLYQETQY

SEQ ID NO: 512 - protein, 12 aa, Homo sapiens
ASSPGTGNTEAF

SEQ ID NO: 513 - protein, 11 aa, Homo sapiens
ASSPQGNQPQH

SEQ ID NO: 514 - protein, 9 aa, Homo sapiens
ASSTYNEQF

SEQ ID NO: 515 - protein, 10 aa, Homo sapiens
ASSSNTDTQY

SEQ ID NO: 516 - protein, 10 aa, Homo sapiens
ASSPRGYEQY

SEQ ID NO: 517 - protein, 11 aa, Homo sapiens
ASSQGGNQPQH

SEQ ID NO: 518 - protein, 9 aa, Homo sapiens
ASSLGDEQF

SEQ ID NO: 519 - protein, 11 aa, Homo sapiens
ASSLRGGTEAF

SEQ ID NO: 520 - protein, 12 aa, Homo sapiens
ASSLGQSNQPQH

SEQ ID NO: 521 - protein, 9 aa, Homo sapiens
ASSLANEQF

SEQ ID NO: 522 - protein, 10 aa, Homo sapiens
ASSLNSYEQY

SEQ ID NO: 523 - protein, 10 aa, Homo sapiens
ASSPGTYEQY

SEQ ID NO: 524 - protein, 11 aa, Homo sapiens
ASSLGTSYEQY

SEQ ID NO: 525 - protein, 11 aa, Homo sapiens
ASSPGGSYEQY

SEQ ID NO: 526 - protein, 11 aa, Homo sapiens
ASSLGPTDTQY

SEQ ID NO: 527 - protein, 11 aa, Homo sapiens
ASSLGQNQPQH

SEQ ID NO: 528 - protein, 11 aa, Homo sapiens
ASSLGGSTEAF

SEQ ID NO: 529 - protein, 11 aa, Homo sapiens
ASSLAGTYEQY

SEQ ID NO: 530 - protein, 9 aa, Homo sapiens
ASSLLYEQY

SEQ ID NO: 531 - protein, 11 aa, Homo sapiens
ASSLGPSYEQY

SEQ ID NO: 532 - protein, 12 aa, Homo sapiens
ASSSGQGNQPQH

SEQ ID NO: 533 - protein, 13 aa, Homo sapiens
ASSPGTSGYNEQF

SEQ ID NO: 534 - protein, 10 aa, Homo sapiens
ASSSGGTEAF

SEQ ID NO: 535 - protein, 9 aa, Homo sapiens
ASSLGNTIY

SEQ ID NO: 536 - protein, 12 aa, Homo sapiens
ASSLGDSNQPQH

SEQ ID NO: 537 - protein, 12 aa, Homo sapiens
ASSLGQGADTQY

SEQ ID NO: 538 - protein, 11 aa, Homo sapiens
ASSLGGPYEQY

SEQ ID NO: 539 - protein, 11 aa, Homo sapiens
ASSLLGTDTQY

SEQ ID NO: 540 - protein, 12 aa, Homo sapiens
ASSLGTGGYEQY

SEQ ID NO: 541 - protein, 11 aa, Homo sapiens
ASSLGGAYEQY

SEQ ID NO: 542 - protein, 10 aa, Homo sapiens
ASSQGNQPQH

SEQ ID NO: 543 - protein, 11 aa, Homo sapiens
ASSLASNQPQH

SEQ ID NO: 544 - protein, 11 aa, Homo sapiens
ASSLGLSYEQY

SEQ ID NO: 545 - protein, 10 aa, Homo sapiens
ASSLDNQPQH

SEQ ID NO: 546 - protein, 10 aa, Homo sapiens
ASSPSYNEQF

SEQ ID NO: 547 - protein, 10 aa, Homo sapiens
ASRDSNQPQH

SEQ ID NO: 548 - protein, 11 aa, Homo sapiens
ASSLSSGNTIY

SEQ ID NO: 549 - protein, 9 aa, Homo sapiens
ASSFGTEAF

SEQ ID NO: 550 - protein, 12 aa, Homo sapiens
ASSLQGLNTEAF

SEQ ID NO: 551 - protein, 9 aa, Homo sapiens
ASSITDTQY

SEQ ID NO: 552 - protein, 10 aa, Homo sapiens
ASSYSNQPQH

SEQ ID NO: 553 - protein, 10 aa, Homo sapiens
ASSPGGDTQY

SEQ ID NO: 554 - protein, 11 aa, Homo sapiens
ASSLDRDQPQH

SEQ ID NO: 555 - protein, 11 aa, Homo sapiens
ASSPGMNTEAF

SEQ ID NO: 556 - protein, 10 aa, Homo sapiens
ASSLPNQPQH

SEQ ID NO: 557 - protein, 11 aa, Homo sapiens
ASSLGPYNEQF

SEQ ID NO: 558 - protein, 11 aa, Homo sapiens
ASSLRQNTEAF

SEQ ID NO: 559 - protein, 10 aa, Homo sapiens
ASSRNTGELF

SEQ ID NO: 560 - protein, 12 aa, Homo sapiens
ASSPSGSTDTQY

SEQ ID NO: 561 - protein, 11 aa, Homo sapiens
ASSLPGTDTQY

SEQ ID NO: 562 - protein, 12 aa, Homo sapiens
ASSLGQGPYEQY

SEQ ID NO: 563 - protein, 9 aa, Homo sapiens
ASSQGNEQF

SEQ ID NO: 564 - protein, 10 aa, Homo sapiens
ASSQGGYEQY

SEQ ID NO: 565 - protein, 10 aa, Homo sapiens
ASSLLGYEQY

SEQ ID NO: 566 - protein, 11 aa, Homo sapiens
ASSLVGNQPQH

SEQ ID NO: 567 - protein, 11 aa, Homo sapiens
ASSLDRAYEQY

SEQ ID NO: 568 - protein, 10 aa, Homo sapiens
ASSPRGTEAF

SEQ ID NO: 569 - protein, 12 aa, Homo sapiens
ASSLVGSTDTQY

SEQ ID NO: 570 - protein, 11 aa, Homo sapiens
ASSLSPNTEAF

SEQ ID NO: 571 - protein, 11 aa, Homo sapiens
ASSPGPNTEAF

SEQ ID NO: 572 - protein, 11 aa, Homo sapiens
ASSYRGNTEAF

SEQ ID NO: 573 - protein, 11 aa, Homo sapiens
ASSLDRDTEAF

SEQ ID NO: 574 - protein, 11 aa, Homo sapiens
ASSSTVNTEAF

SEQ ID NO: 575 - protein, 10 aa, Homo sapiens
ASSSLTDTQY

SEQ ID NO: 576 - protein, 10 aa, Homo sapiens
ASSLLGQPQH

SEQ ID NO: 577 - protein, 10 aa, Homo sapiens
ASSLAGTEAF

SEQ ID NO: 578 - protein, 9 aa, Homo sapiens
ASSSEETQY

SEQ ID NO: 579 - protein, 10 aa, Homo sapiens
ASSLASYEQY

SEQ ID NO: 580 - protein, 9 aa, Homo sapiens
ASSLSTEAF

SEQ ID NO: 581 - protein, 12 aa, Homo sapiens
ASSPGQLNTEAF

SEQ ID NO: 582 - protein, 10 aa, Homo sapiens
ASSRSSYEQY

SEQ ID NO: 583 - protein, 9 aa, Homo sapiens
ASSPGNEQF

SEQ ID NO: 584 - protein, 12 aa, Homo sapiens
ASSLQGMNTEAF

SEQ ID NO: 585 - protein, 9 aa, Homo sapiens
ASSQTDTQY

SEQ ID NO: 586 - protein, 9 aa, Homo sapiens
ASSQGTEAF

SEQ ID NO: 587 - protein, 9 aa, Homo sapiens
ASSFSETQY

SEQ ID NO: 588 - protein, 13 aa, Homo sapiens
ASSPSGSSYNEQF

SEQ ID NO: 589 - protein, 11 aa, Homo sapiens
ASSLDSNYGYT

SEQ ID NO: 590 - protein, 11 aa, Homo sapiens
ASSLGNTGELF

SEQ ID NO: 591 - protein, 9 aa, Homo sapiens
ASSEGYEQY

SEQ ID NO: 592 - protein, 12 aa, Homo sapiens
ASSLTGVNTEAF

SEQ ID NO: 593 - protein, 11 aa, Homo sapiens
ASSQGMNTEAF

SEQ ID NO: 594 - protein, 9 aa, Homo sapiens
ASSYYNEQF

SEQ ID NO: 595 - protein, 9 aa, Homo sapiens
ASSFEETQY

SEQ ID NO: 596 - protein, 9 aa, Homo sapiens
ASSLGEKLF

SEQ ID NO: 597 - protein, 9 aa, Homo sapiens
ASRSTDTQY

SEQ ID NO: 598 - protein, 11 aa, Homo sapiens
ASSPDSNYGYT

SEQ ID NO: 599 - protein, 12 aa, Homo sapiens
ASSLGTGAYEQY

SEQ ID NO: 600 - protein, 11 aa, Homo sapiens
ASSLTGDQPQH

SEQ ID NO: 601 - protein, 11 aa, Homo sapiens
ASSLPSTDTQY

SEQ ID NO: 602 - protein, 12 aa, Homo sapiens
ASSLQGGNQPQH

SEQ ID NO: 603 - protein, 10 aa, Homo sapiens
ASSLDRETQY

SEQ ID NO: 604 - protein, 11 aa, Homo sapiens
ASSRDRAYEQY

SEQ ID NO: 605 - protein, 12 aa, Homo sapiens
ASSLTSGSYEQY

SEQ ID NO: 606 - protein, 9 aa, Homo sapiens
ASSRGNEQF

SEQ ID NO: 607 - protein, 11 aa, Homo sapiens
ASSFGGSYEQY

SEQ ID NO: 608 - protein, 10 aa, Homo sapiens
ASSQDSYEQY

SEQ ID NO: 609 - protein, 10 aa, Homo sapiens
ASSLGGNTIY

SEQ ID NO: 610 - protein, 13 aa, Homo sapiens
ASSLLAGGTDTQY

SEQ ID NO: 611 - protein, 11 aa, Homo sapiens
ASSVGGNTEAF

SEQ ID NO: 612 - protein, 9 aa, Homo sapiens
ASSQNTEAF

SEQ ID NO: 613 - protein, 11 aa, Homo sapiens
ASSLELNTEAF

SEQ ID NO: 614 - protein, 11 aa, Homo sapiens
ASSFTGNTEAF

SEQ ID NO: 615 - protein, 12 aa, Homo sapiens
ASSSGSSYNEQF

SEQ ID NO: 616 - protein, 9 aa, Homo sapiens
ASSSGNTIY

SEQ ID NO: 617 - protein, 11 aa, Homo sapiens
ASSLDMNTEAF

SEQ ID NO: 618 - protein, 11 aa, Homo sapiens
ASSPSGANVLT

SEQ ID NO: 619 - protein, 9 aa, Homo sapiens
ASRGNTEAF

SEQ ID NO: 620 - protein, 12 aa, Homo sapiens
ASSPGLATDTQY

SEQ ID NO: 621 - protein, 10 aa, Homo sapiens
ASSLQGTEAF

SEQ ID NO: 622 - protein, 11 aa, Homo sapiens
ASSFDSNQPQH

SEQ ID NO: 623 - protein, 9 aa, Homo sapiens
ASSAYNEQF

SEQ ID NO: 624 - protein, 10 aa, Homo sapiens
ASSLDYNEQF

SEQ ID NO: 625 - protein, 12 aa, Homo sapiens
ASSLVGGNTEAF

SEQ ID NO: 626 - protein, 12 aa, Homo sapiens
ASSLSGSNQPQH

SEQ ID NO: 627 - protein, 11 aa, Homo sapiens
ASSGTGNQPQH

SEQ ID NO: 628 - protein, 11 aa, Homo sapiens
ASSRQGNQPQH

SEQ ID NO: 629 - protein, 11 aa, Homo sapiens
ASSQGQNTEAF

SEQ ID NO: 630 - protein, 11 aa, Homo sapiens
ASSLSMNTEAF

SEQ ID NO: 631 - protein, 9 aa, Homo sapiens
ASSTSYEQY

SEQ ID NO: 632 - protein, 11 aa, Homo sapiens
ASSLRGQETQY

SEQ ID NO: 633 - protein, 11 aa, Homo sapiens
ASSPGQTYEQY

SEQ ID NO: 634 - protein, 11 aa, Homo sapiens
ASSFSGANVLT

SEQ ID NO: 635 - protein, 11 aa, Homo sapiens
ASSFRGNTEAF

SEQ ID NO: 636 - protein, 12 aa, Homo sapiens
ASSLDRGNTEAF

SEQ ID NO: 637 - protein, 11 aa, Homo sapiens
ASSPDRNQPQH

SEQ ID NO: 638 - protein, 9 aa, Homo sapiens
ASSVYNEQF

SEQ ID NO: 639 - protein, 11 aa, Homo sapiens
ASSPGTGYEQY

SEQ ID NO: 640 - protein, 11 aa, Homo sapiens
ASSPRGTDTQY

SEQ ID NO: 641 - protein, 12 aa, Homo sapiens
ASSLRGSTDTQY

SEQ ID NO: 642 - protein, 11 aa, Homo sapiens
ASSPGVNTEAF

SEQ ID NO: 643 - protein, 11 aa, Homo sapiens
ASSLGGTGELF

SEQ ID NO: 644 - protein, 12 aa, Homo sapiens
ASSLGGGSYEQY

SEQ ID NO: 645 - protein, 10 aa, Homo sapiens
ASSLLGETQY

SEQ ID NO: 646 - protein, 9 aa, Homo sapiens
ASSVSYEQY

SEQ ID NO: 647 - protein, 12 aa, Homo sapiens
ASSSGQGNTEAF

SEQ ID NO: 648 - protein, 9 aa, Homo sapiens
ASSLNYGYT

SEQ ID NO: 649 - protein, 10 aa, Homo sapiens
ASSSGNTEAF

SEQ ID NO: 650 - protein, 12 aa, Homo sapiens
ASSLAGMNTEAF

SEQ ID NO: 651 - protein, 10 aa, Homo sapiens
ASSPGYNEQF

SEQ ID NO: 652 - protein, 9 aa, Homo sapiens
ASSPNYEQY

SEQ ID NO: 653 - protein, 10 aa, Homo sapiens
ASSSTGYEQY

SEQ ID NO: 654 - protein, 10 aa, Homo sapiens
ASSDSNQPQH

SEQ ID NO: 655 - protein, 9 aa, Homo sapiens
ASRRNTEAF

SEQ ID NO: 656 - protein, 9 aa, Homo sapiens
ASSNSYEQY

SEQ ID NO: 657 - protein, 12 aa, Homo sapiens
ASSSGTGSYEQY

SEQ ID NO: 658 - protein, 10 aa, Homo sapiens
ASSLGYTEAF

SEQ ID NO: 659 - protein, 11 aa, Homo sapiens
ASSLWGNTEAF

SEQ ID NO: 660 - protein, 13 aa, Homo sapiens
ASSLGLAGTDTQY

SEQ ID NO: 661 - protein, 12 aa, Homo sapiens
ASSLAGLNTEAF

SEQ ID NO: 662 - protein, 11 aa, Homo sapiens
ASSFSGNTEAF

SEQ ID NO: 663 - protein, 10 aa, Homo sapiens
ASSSSGNTIY

SEQ ID NO: 664 - protein, 10 aa, Homo sapiens
ASSSGGYEQY

SEQ ID NO: 665 - protein, 11 aa, Homo sapiens
ASSRGLNTEAF

SEQ ID NO: 666 - protein, 12 aa, Homo sapiens
ASSLSSGANVLT

SEQ ID NO: 667 - protein, 11 aa, Homo sapiens
ASSLEMNTEAF

SEQ ID NO: 668 - protein, 9 aa, Homo sapiens
ASSLGDEQY

SEQ ID NO: 669 - protein, 12 aa, Homo sapiens
ASSLTGSSYEQY

SEQ ID NO: 670 - protein, 11 aa, Homo sapiens
ASSSGLNTEAF

SEQ ID NO: 671 - protein, 12 aa, Homo sapiens
ASSLGQNTGELF

SEQ ID NO: 672 - protein, 10 aa, Homo sapiens
ASSLANTEAF

SEQ ID NO: 673 - protein, 10 aa, Homo sapiens
ASSPLNTEAF

SEQ ID NO: 674 - protein, 12 aa, Homo sapiens
ASSPGLSTDTQY

SEQ ID NO: 675 - protein, 9 aa, Homo sapiens
ASSPRDTQY

SEQ ID NO: 676 - protein, 11 aa, Homo sapiens
ASSLAGANVLT

SEQ ID NO: 677 - protein, 9 aa, Homo sapiens
ASSGSYEQY

SEQ ID NO: 678 - protein, 10 aa, Homo sapiens
ASSLSGQPQH

SEQ ID NO: 679 - protein, 11 aa, Homo sapiens
ASSLQGNYGYT

SEQ ID NO: 680 - protein, 9 aa, Homo sapiens
ASSFLETQY

SEQ ID NO: 681 - protein, 11 aa, Homo sapiens
ASSLSGQETQY

SEQ ID NO: 682 - protein, 11 aa, Homo sapiens
ASSFDRNTEAF

SEQ ID NO: 683 - protein, 12 aa, Homo sapiens
ASSGTGGNQPQH

SEQ ID NO: 684 - protein, 10 aa, Homo sapiens
ASSLEGTEAF

SEQ ID NO: 685 - protein, 10 aa, Homo sapiens
ASSLENTEAF

SEQ ID NO: 686 - protein, 11 aa, Homo sapiens
ASSLVVNTEAF

SEQ ID NO: 687 - protein, 10 aa, Homo sapiens
ASSLTNTEAF

SEQ ID NO: 688 - protein, 12 aa, Homo sapiens
ASSRDRGTDTQY

SEQ ID NO: 689 - protein, 11 aa, Homo sapiens
ASSFRGTDTQY

SEQ ID NO: 690 - protein, 10 aa, Homo sapiens
ASSLAGQPQH

SEQ ID NO: 691 - protein, 12 aa, Homo sapiens
ASSPGTSTDTQY

SEQ ID NO: 692 - protein, 10 aa, Homo sapiens
ASSLVGQPQH

SEQ ID NO: 693 - protein, 12 aa, Homo sapiens
ASSLDRVNTEAF

SEQ ID NO: 694 - protein, 9 aa, Homo sapiens
ASSNQETQY

SEQ ID NO: 695 - protein, 12 aa, Homo sapiens
ASSLGQGNYGYT

SEQ ID NO: 696 - protein, 11 aa, Homo sapiens
ASSQGVNTEAF

SEQ ID NO: 697 - protein, 12 aa, Homo sapiens
ASSPGQGPYEQY

SEQ ID NO: 698 - protein, 9 aa, Homo sapiens
ASSGGYEQY

SEQ ID NO: 699 - protein, 12 aa, Homo sapiens
ASSLAGAYNEQF

SEQ ID NO: 700 - protein, 9 aa, Homo sapiens
ASSATDTQY

SEQ ID NO: 701 - protein, 9 aa, Homo sapiens
ASSSADTQY

SEQ ID NO: 702 - protein, 10 aa, Homo sapiens
ASSLVPDTQY

SEQ ID NO: 703 - protein, 11 aa, Homo sapiens
ASSLERNTEAF

SEQ ID NO: 704 - protein, 12 aa, Homo sapiens
ASSLDRGNQPQH

SEQ ID NO: 705 - protein, 9 aa, Homo sapiens
ASSLYYEQY

SEQ ID NO: 706 - protein, 12 aa, Homo sapiens
ASSLVGGTDTQY

SEQ ID NO: 707 - protein, 12 aa, Homo sapiens
ASSPRTGNTEAF

SEQ ID NO: 708 - protein, 11 aa, Homo sapiens
ASSQDRNQPQH

SEQ ID NO: 709 - protein, 11 aa, Homo sapiens
ASSSGGTDTQY

SEQ ID NO: 710 - protein, 9 aa, Homo sapiens
ASSLVYEQY

SEQ ID NO: 711 - protein, 9 aa, Homo sapiens
ASSLRTEAF

SEQ ID NO: 712 - protein, 11 aa, Homo sapiens
ASSLLGNQPQH

SEQ ID NO: 713 - protein, 11 aa, Homo sapiens
ASSLVGGTEAF

SEQ ID NO: 714 - protein, 13 aa, Homo sapiens
ASSLGLAGYNEQF

SEQ ID NO: 715 - protein, 11 aa, Homo sapiens
ASSFGVNTEAF

SEQ ID NO: 716 - protein, 10 aa, Homo sapiens
ASSLLGDTQY

SEQ ID NO: 717 - protein, 9 aa, Homo sapiens
ASSQTYEQY

SEQ ID NO: 718 - protein, 12 aa, Homo sapiens
ASSPGTGTYEQY

SEQ ID NO: 719 - protein, 11 aa, Homo sapiens
ASSFGLNTEAF

SEQ ID NO: 720 - protein, 11 aa, Homo sapiens
ASSPGTSYEQY

SEQ ID NO: 721 - protein, 10 aa, Homo sapiens
ASSLLGTEAF

SEQ ID NO: 722 - protein, 11 aa, Homo sapiens
ASSLRGSYEQY

SEQ ID NO: 723 - protein, 10 aa, Homo sapiens
ASSLRGETQY

SEQ ID NO: 724 - protein, 12 aa, Homo sapiens
ASSLGQANTEAF

SEQ ID NO: 725 - protein, 10 aa, Homo sapiens
ASSLDRYEQY

SEQ ID NO: 726 - protein, 10 aa, Homo sapiens
ASSPGPYEQY

SEQ ID NO: 727 - protein, 11 aa, Homo sapiens
ASSSYSNQPQH

SEQ ID NO: 728 - protein, 10 aa, Homo sapiens
ASSLQGYGYT

SEQ ID NO: 729 - protein, 11 aa, Homo sapiens
ASSLGRNYGYT

SEQ ID NO: 730 - protein, 10 aa, Homo sapiens
ASSLETDTQY

SEQ ID NO: 731 - protein, 11 aa, Homo sapiens
ASSLGGGETQY

SEQ ID NO: 732 - protein, 9 aa, Homo sapiens
ASSFRDTQY

SEQ ID NO: 733 - protein, 11 aa, Homo sapiens
ASSLASSYEQY

SEQ ID NO: 734 - protein, 9 aa, Homo sapiens
ASSQADTQY

SEQ ID NO: 735 - protein, 12 aa, Homo sapiens
ASSLGRMNTEAF

SEQ ID NO: 736 - protein, 10 aa, Homo sapiens
ASSLQGNEQF

SEQ ID NO: 737 - protein, 12 aa, Homo sapiens
ASSLGQVNTEAF

SEQ ID NO: 738 - protein, 12 aa, Homo sapiens
ASSLRGSNQPQH

SEQ ID NO: 739 - protein, 11 aa, Homo sapiens
ASSLVGSYEQY

SEQ ID NO: 740 - protein, 9 aa, Homo sapiens
ASSGTDTQY

SEQ ID NO: 741 - protein, 12 aa, Homo sapiens
ASSLGYSNQPQH

SEQ ID NO: 742 - protein, 12 aa, Homo sapiens
ASSLGGVNTEAF

SEQ ID NO: 743 - protein, 10 aa, Homo sapiens
ASSLTYNEQF

SEQ ID NO: 744 - protein, 11 aa, Homo sapiens
ASSLVLNTEAF

SEQ ID NO: 745 - protein, 11 aa, Homo sapiens
ASSPDSYNEQF

SEQ ID NO: 746 - protein, 12 aa, Homo sapiens
ASSLGQGTYEQY

SEQ ID NO: 747 - protein, 11 aa, Homo sapiens
ASSLTRNTEAF

SEQ ID NO: 748 - protein, 11 aa, Homo sapiens
ASSLQGDTEAF

SEQ ID NO: 749 - protein, 12 aa, Homo sapiens
ASSLTGGSYEQY

SEQ ID NO: 750 - protein, 10 aa, Homo sapiens
ASSYSSYEQY

SEQ ID NO: 751 - protein, 10 aa, Homo sapiens
ASSSTTDTQY

SEQ ID NO: 752 - protein, 11 aa, Homo sapiens
ASSLDGNYGYT

SEQ ID NO: 753 - protein, 11 aa, Homo sapiens
ASSLVSNQPQH

SEQ ID NO: 754 - protein, 10 aa, Homo sapiens
ASSPGGNEQF

SEQ ID NO: 755 - protein, 10 aa, Homo sapiens
ASSGGTDTQY

SEQ ID NO: 756 - protein, 10 aa, Homo sapiens
ASSPRGETQY

SEQ ID NO: 757 - protein, 10 aa, Homo sapiens
ASSLVSDTQY

SEQ ID NO: 758 - protein, 11 aa, Homo sapiens
ASSPYSNQPQH

SEQ ID NO: 759 - protein, 11 aa, Homo sapiens
ASSLGRYNEQF

SEQ ID NO: 760 - protein, 11 aa, Homo sapiens
ASSRTGGTEAF

SEQ ID NO: 761 - protein, 10 aa, Homo sapiens
ASSSLNTEAF

SEQ ID NO: 762 - protein, 12 aa, Homo sapiens
ASSPGGSYNEQF

SEQ ID NO: 763 - protein, 13 aa, Homo sapiens
ASSLAGGPYNEQF

SEQ ID NO: 764 - protein, 10 aa, Homo sapiens
ASSLEADTQY

SEQ ID NO: 765 - protein, 11 aa, Homo sapiens
ASSLGGGQPQH

SEQ ID NO: 766 - protein, 11 aa, Homo sapiens
ASSRTANTEAF

SEQ ID NO: 767 - protein, 9 aa, Homo sapiens
ASSLEYEQY

SEQ ID NO: 768 - protein, 11 aa, Homo sapiens
ASSPPSSYEQY

SEQ ID NO: 769 - protein, 8 aa, Homo sapiens
ASSLETQY

SEQ ID NO: 770 - protein, 11 aa, Homo sapiens
ASSLGRTYEQY

SEQ ID NO: 771 - protein, 9 aa, Homo sapiens
ASSEYNEQF

SEQ ID NO: 772 - protein, 10 aa, Homo sapiens
ASSLLNQPQH

SEQ ID NO: 773 - protein, 9 aa, Homo sapiens
ASSYGYEQY

SEQ ID NO: 774 - protein, 13 aa, Homo sapiens
ASSLLAGGYNEQF

SEQ ID NO: 775 - protein, 11 aa, Homo sapiens
ASSQDRDQPQH

SEQ ID NO: 776 - protein, 10 aa, Homo sapiens
ASSLGRDTQY

SEQ ID NO: 777 - protein, 11 aa, Homo sapiens
ASSLSSSYEQY

SEQ ID NO: 778 - protein, 12 aa, Homo sapiens
ASSLGSSTDTQY

SEQ ID NO: 779 - protein, 11 aa, Homo sapiens
ASSPGQAYEQY

SEQ ID NO: 780 - protein, 11 aa, Homo sapiens
ASSYGGNTEAF

SEQ ID NO: 781 - protein, 11 aa, Homo sapiens
ASSLRGDTEAF

SEQ ID NO: 782 - protein, 12 aa, Homo sapiens
ASSLSGSYNEQF

SEQ ID NO: 783 - protein, 10 aa, Homo sapiens
ASSLEGDTQY

SEQ ID NO: 784 - protein, 10 aa, Homo sapiens
ASSLEGETQY

SEQ ID NO: 785 - protein, 12 aa, Homo sapiens
ASSLGQGNSPLH

SEQ ID NO: 786 - protein, 10 aa, Homo sapiens
ASSFSGNTIY

SEQ ID NO: 787 - protein, 9 aa, Homo sapiens
ASSFGNEQF

SEQ ID NO: 788 - protein, 11 aa, Homo sapiens
ASSLRSNQPQH

SEQ ID NO: 789 - protein, 11 aa, Homo sapiens
ASSLDPNTEAF

SEQ ID NO: 790 - protein, 9 aa, Homo sapiens
ASSDTDTQY

SEQ ID NO: 791 - protein, 11 aa, Homo sapiens
ASSLGRGTEAF

SEQ ID NO: 792 - protein, 12 aa, Homo sapiens
ASSLGSSGNTIY

SEQ ID NO: 793 - protein, 9 aa, Homo sapiens
ASSLKDTQY

SEQ ID NO: 794 - protein, 11 aa, Homo sapiens
ASSLAANTEAF

SEQ ID NO: 795 - protein, 10 aa, Homo sapiens
ASSLAGNTIY

SEQ ID NO: 796 - protein, 11 aa, Homo sapiens
ASSPGSYNEQF

SEQ ID NO: 797 - protein, 9 aa, Homo sapiens
ASSSSDTQY

SEQ ID NO: 798 - protein, 11 aa, Homo sapiens
ASSLTSNQPQH

SEQ ID NO: 799 - protein, 11 aa, Homo sapiens
ASSLDSNTEAF

SEQ ID NO: 800 - protein, 11 aa, Homo sapiens
ASSQDRGQPQH

SEQ ID NO: 801 - protein, 10 aa, Homo sapiens
ASSLTGNEQF

SEQ ID NO: 802 - protein, 11 aa, Homo sapiens
ASSPTGNQPQH

SEQ ID NO: 803 - protein, 12 aa, Homo sapiens
ASSLQGANTEAF

SEQ ID NO: 804 - protein, 12 aa, Homo sapiens
ASSLGQGGQPQH

SEQ ID NO: 805 - protein, 9 aa, Homo sapiens
ASSSRYEQY

SEQ ID NO: 806 - protein, 10 aa, Homo sapiens
ASSPRNTEAF

SEQ ID NO: 807 - protein, 11 aa, Homo sapiens
ASSLRLNTEAF

SEQ ID NO: 808 - protein, 11 aa, Homo sapiens
ASSLNRNTEAF

SEQ ID NO: 809 - protein, 10 aa, Homo sapiens
ASSLGRTEAF

SEQ ID NO: 810 - protein, 10 aa, Homo sapiens
ASSFLNTEAF

SEQ ID NO: 811 - protein, 12 aa, Homo sapiens
ASSLAGSGNTIY

SEQ ID NO: 812 - protein, 11 aa, Homo sapiens
ASSYRENTEAF

SEQ ID NO: 813 - protein, 10 aa, Homo sapiens
ASSPPSYEQY

SEQ ID NO: 814 - protein, 11 aa, Homo sapiens
ASSLTGQETQY

SEQ ID NO: 815 - protein, 10 aa, Homo sapiens
ASSLRADTQY

SEQ ID NO: 816 - protein, 11 aa, Homo sapiens
ASSLGGRETQY

SEQ ID NO: 817 - protein, 11 aa, Homo sapiens
ASSLLSTDTQY

SEQ ID NO: 818 - protein, 11 aa, Homo sapiens
ASSLGTGYEQY

SEQ ID NO: 819 - protein, 10 aa, Homo sapiens
ASSPPGETQY

SEQ ID NO: 820 - protein, 10 aa, Homo sapiens
ASSLSTGELF

SEQ ID NO: 821 - protein, 12 aa, Homo sapiens
ASSPGSSYNEQF

SEQ ID NO: 822 - protein, 10 aa, Homo sapiens
ASSLSGTEAF

SEQ ID NO: 823 - protein, 9 aa, Homo sapiens
ASSIGETQY

SEQ ID NO: 824 - protein, 13 aa, Homo sapiens
ASSLTSGSYNEQF

SEQ ID NO: 825 - protein, 11 aa, Homo sapiens
ASSLSENTEAF

SEQ ID NO: 826 - protein, 9 aa, Homo sapiens
ASSSNYGYT

SEQ ID NO: 827 - protein, 11 aa, Homo sapiens
ASSQQGNTEAF

SEQ ID NO: 828 - protein, 11 aa, Homo sapiens
ASSSDSNQPQH

SEQ ID NO: 829 - protein, 11 aa, Homo sapiens
ASSSSGANVLT

SEQ ID NO: 830 - protein, 12 aa, Homo sapiens
ASSLGLAGDTQY

SEQ ID NO: 831 - protein, 11 aa, Homo sapiens
ASSSGSSYEQY

SEQ ID NO: 832 - protein, 11 aa, Homo sapiens
ASSLGVSYEQY

SEQ ID NO: 833 - protein, 9 aa, Homo sapiens
ASSPGYGYT

SEQ ID NO: 834 - protein, 10 aa, Homo sapiens
ASSPSNQPQH

SEQ ID NO: 835 - protein, 12 aa, Homo sapiens
ASSLGGRTDTQY

SEQ ID NO: 836 - protein, 12 aa, Homo sapiens
ASSRTGGNQPQH

SEQ ID NO: 837 - protein, 10 aa, Homo sapiens
ASSVSTDTQY

SEQ ID NO: 838 - protein, 12 aa, Homo sapiens
ASSLRGLNTEAF

SEQ ID NO: 839 - protein, 11 aa, Homo sapiens
ASSSTGGTEAF

SEQ ID NO: 840 - protein, 9 aa, Homo sapiens
ASSQEETQY

SEQ ID NO: 841 - protein, 9 aa, Homo sapiens
ASSLGGEAF

SEQ ID NO: 842 - protein, 9 aa, Homo sapiens
ASSLNQPQH

SEQ ID NO: 843 - protein, 10 aa, Homo sapiens
ASSRGGTEAF

SEQ ID NO: 844 - protein, 12 aa, Homo sapiens
ASSPGQGNYGYT

SEQ ID NO: 845 - protein, 11 aa, Homo sapiens
ASSLAGNYGYT

SEQ ID NO: 846 - protein, 9 aa, Homo sapiens
ASSPLYEQY

SEQ ID NO: 847 - protein, 12 aa, Homo sapiens
ASSLGTGTDTQY

SEQ ID NO: 848 - protein, 11 aa, Homo sapiens
ASSLGRDQPQH

SEQ ID NO: 849 - protein, 10 aa, Homo sapiens
ASSLDTGELF

SEQ ID NO: 850 - protein, 13 aa, Homo sapiens
ASSLGTSGYNEQF

SEQ ID NO: 851 - protein, 10 aa, Homo sapiens
ASSQSSYEQY

SEQ ID NO: 852 - protein, 12 aa, Homo sapiens
ASSLGGGQETQY

SEQ ID NO: 853 - protein, 10 aa, Homo sapiens
ASSPQGNEQF

SEQ ID NO: 854 - protein, 11 aa, Homo sapiens
ASSLVRNTEAF

SEQ ID NO: 855 - protein, 12 aa, Homo sapiens
ASSPGQMNTEAF

SEQ ID NO: 856 - protein, 13 aa, Homo sapiens
ASSLGGGSYNEQF

SEQ ID NO: 857 - protein, 12 aa, Homo sapiens
ASSLRGGTDTQY

SEQ ID NO: 858 - protein, 10 aa, Homo sapiens
ASSPGAYEQY

SEQ ID NO: 859 - protein, 10 aa, Homo sapiens
ASSPRGDTQY

SEQ ID NO: 860 - protein, 12 aa, Homo sapiens
ASSFGGSNQPQH

SEQ ID NO: 861 - protein, 10 aa, Homo sapiens
ASSLEGQPQH

SEQ ID NO: 862 - protein, 11 aa, Homo sapiens
ASSLGQNNEQF

SEQ ID NO: 863 - protein, 11 aa, Homo sapiens
ASSLASYNEQF

SEQ ID NO: 864 - protein, 10 aa, Homo sapiens
ASSYGGTEAF

SEQ ID NO: 865 - protein, 9 aa, Homo sapiens
ASSPSDTQY

SEQ ID NO: 866 - protein, 12 aa, Homo sapiens
ASSLGQGQETQY

SEQ ID NO: 867 - protein, 10 aa, Homo sapiens
ASSSNTGELF

SEQ ID NO: 868 - protein, 10 aa, Homo sapiens
ASSLVRETQY

SEQ ID NO: 869 - protein, 10 aa, Homo sapiens
ASSSYQETQY

SEQ ID NO: 870 - protein, 11 aa, Homo sapiens
ASSLGGYTEAF

SEQ ID NO: 871 - protein, 12 aa, Homo sapiens
ASSLDSSYNEQF

SEQ ID NO: 872 - protein, 10 aa, Homo sapiens
ASSPPNQPQH

SEQ ID NO: 873 - protein, 10 aa, Homo sapiens
ASSLRNQPQH

SEQ ID NO: 874 - protein, 11 aa, Homo sapiens
ASSFSSNQPQH

SEQ ID NO: 875 - protein, 12 aa, Homo sapiens
ASSLVGSNQPQH

SEQ ID NO: 876 - protein, 11 aa, Homo sapiens
ASSPGTGYGYT

SEQ ID NO: 877 - protein, 12 aa, Homo sapiens
ASSPDRGNQPQH

SEQ ID NO: 878 - protein, 9 aa, Homo sapiens
ASSDYNEQF

SEQ ID NO: 879 - protein, 11 aa, Homo sapiens
ASSQDRGYEQY

SEQ ID NO: 880 - protein, 12 aa, Homo sapiens
ASSPGQSTDTQY

SEQ ID NO: 881 - protein, 11 aa, Homo sapiens
ASSYSGNTEAF

SEQ ID NO: 882 - protein, 10 aa, Homo sapiens
ASSLSNTEAF

SEQ ID NO: 883 - protein, 11 aa, Homo sapiens
ASSLDRGYGYT

SEQ ID NO: 884 - protein, 11 aa, Homo sapiens
ASSPRSTDTQY

SEQ ID NO: 885 - protein, 11 aa, Homo sapiens
ASSLGVNQPQH

SEQ ID NO: 886 - protein, 10 aa, Homo sapiens
ASSPGQETQY

SEQ ID NO: 887 - protein, 9 aa, Homo sapiens
ASSESYEQY

SEQ ID NO: 888 - protein, 10 aa, Homo sapiens
ASSLTQETQY

SEQ ID NO: 889 - protein, 11 aa, Homo sapiens
ASSGQLNTEAF

SEQ ID NO: 890 - protein, 11 aa, Homo sapiens
ASSPPGNTEAF

SEQ ID NO: 891 - protein, 10 aa, Homo sapiens
ASSLLADTQY

SEQ ID NO: 892 - protein, 10 aa, Homo sapiens
ASSPNSYEQY

SEQ ID NO: 893 - protein, 12 aa, Homo sapiens
ASSLGRGTDTQY

SEQ ID NO: 894 - protein, 10 aa, Homo sapiens
ASSLNQETQY

SEQ ID NO: 895 - protein, 11 aa, Homo sapiens
ASSLTGYNEQF

SEQ ID NO: 896 - protein, 13 aa, Homo sapiens
ASSSSGSSYNEQF

SEQ ID NO: 897 - protein, 11 aa, Homo sapiens
ASSLRMNTEAF

SEQ ID NO: 898 - protein, 10 aa, Homo sapiens
ASSLITDTQY

SEQ ID NO: 899 - protein, 11 aa, Homo sapiens
ASSLGVQETQY

SEQ ID NO: 900 - protein, 11 aa, Homo sapiens
ASSLTGTYEQY

SEQ ID NO: 901 - protein, 11 aa, Homo sapiens
ASSLESNQPQH

SEQ ID NO: 902 - protein, 11 aa, Homo sapiens
ASSLVENTEAF

SEQ ID NO: 903 - protein, 10 aa, Homo sapiens
ASSTGNTEAF

SEQ ID NO: 904 - protein, 10 aa, Homo sapiens
ASSLGSTEAF

SEQ ID NO: 905 - protein, 12 aa, Homo sapiens
ASSLGGSQETQY

SEQ ID NO: 906 - protein, 12 aa, Homo sapiens
ASSLAGVNTEAF

SEQ ID NO: 907 - protein, 9 aa, Homo sapiens
ASSSRDTQY

SEQ ID NO: 908 - protein, 11 aa, Homo sapiens
ASSPTENTEAF

SEQ ID NO: 909 - protein, 10 aa, Homo sapiens
ASSRGSYEQY

SEQ ID NO: 910 - protein, 12 aa, Homo sapiens
ASSPGGGNQPQH

SEQ ID NO: 911 - protein, 9 aa, Homo sapiens
ASSPADTQY

SEQ ID NO: 912 - protein, 10 aa, Homo sapiens
ASSLAGYGYT

SEQ ID NO: 913 - protein, 11 aa, Homo sapiens
ASSLGVTDTQY

SEQ ID NO: 914 - protein, 11 aa, Homo sapiens
ASSPGGGTEAF

SEQ ID NO: 915 - protein, 10 aa, Homo sapiens
ASSLGVYEQY

SEQ ID NO: 916 - protein, 9 aa, Homo sapiens
ASRENTEAF

SEQ ID NO: 917 - protein, 11 aa, Homo sapiens
ASSLTGGYEQY

SEQ ID NO: 918 - protein, 9 aa, Homo sapiens
ASSLAGEQY

SEQ ID NO: 919 - protein, 11 aa, Homo sapiens
ASSLGLNQPQH

SEQ ID NO: 920 - protein, 9 aa, Homo sapiens
ASSYRETQY

SEQ ID NO: 921 - protein, 11 aa, Homo sapiens
ASSSGQGYGYT

SEQ ID NO: 922 - protein, 11 aa, Homo sapiens
ASSQGGTDTQY

SEQ ID NO: 923 - protein, 13 aa, Homo sapiens
ASSLTSGSTDTQY

SEQ ID NO: 924 - protein, 9 aa, Homo sapiens
ASSLYTEAF

SEQ ID NO: 925 - protein, 11 aa, Homo sapiens
ASSPTGSYEQY

SEQ ID NO: 926 - protein, 9 aa, Homo sapiens
ASSRTYEQY

SEQ ID NO: 927 - protein, 11 aa, Homo sapiens
ASSLAGDQPQH

SEQ ID NO: 928 - protein, 11 aa, Homo sapiens
ASSLQMNTEAF

SEQ ID NO: 929 - protein, 11 aa, Homo sapiens
ASSPPGSYEQY

SEQ ID NO: 930 - protein, 10 aa, Homo sapiens
ASSRTGYEQY

SEQ ID NO: 931 - protein, 10 aa, Homo sapiens
ASSLLSYEQY

SEQ ID NO: 932 - protein, 11 aa, Homo sapiens
ASSLGRDTEAF

SEQ ID NO: 933 - protein, 11 aa, Homo sapiens
ASSQGQGYEQY

SEQ ID NO: 934 - protein, 11 aa, Homo sapiens
ASSLRRNTEAF

SEQ ID NO: 935 - protein, 12 aa, Homo sapiens
ASSLDRSTDTQY

SEQ ID NO: 936 - protein, 8 aa, Homo sapiens
ASSLNEQF

SEQ ID NO: 937 - protein, 12 aa, Homo sapiens
ASSLGGANTEAF

SEQ ID NO: 938 - protein, 11 aa, Homo sapiens
ASSLDSQETQY

SEQ ID NO: 939 - protein, 11 aa, Homo sapiens
ASSPDRGYGYT

SEQ ID NO: 940 - protein, 11 aa, Homo sapiens
ASSLGANYGYT

SEQ ID NO: 941 - protein, 12 aa, Homo sapiens
ASSLGSGANVLT

SEQ ID NO: 942 - protein, 11 aa, Homo sapiens
ASSLGGGNEQF

SEQ ID NO: 943 - protein, 8 aa, Homo sapiens
ASSGETQY

SEQ ID NO: 944 - protein, 10 aa, Homo sapiens
ASSYGNTEAF

SEQ ID NO: 945 - protein, 11 aa, Homo sapiens
ASSPTSTDTQY

SEQ ID NO: 946 - protein, 9 aa, Homo sapiens
ASSFNTEAF

SEQ ID NO: 947 - protein, 13 aa, Homo sapiens
ASSLGQGSYNEQF

SEQ ID NO: 948 - protein, 9 aa, Homo sapiens
ASTSTDTQY

SEQ ID NO: 949 - protein, 11 aa, Homo sapiens
ASSLGLAYEQY

SEQ ID NO: 950 - protein, 10 aa, Homo sapiens
ASSPSGYEQY

SEQ ID NO: 951 - protein, 10 aa, Homo sapiens
ASSLRGQPQH

SEQ ID NO: 952 - protein, 11 aa, Homo sapiens
ASSLDRSYEQY

SEQ ID NO: 953 - protein, 11 aa, Homo sapiens
ASSLDRTDTQY

SEQ ID NO: 954 - protein, 11 aa, Homo sapiens
ASSSGSYNEQF

SEQ ID NO: 955 - protein, 9 aa, Homo sapiens
ASSLSGELF

SEQ ID NO: 956 - protein, 11 aa, Homo sapiens
ASSSQGNQPQH

SEQ ID NO: 957 - protein, 12 aa, Homo sapiens
ASSLGTGGTEAF

SEQ ID NO: 958 - protein, 11 aa, Homo sapiens
ASSLQGDQPQH

SEQ ID NO: 959 - protein, 11 aa, Homo sapiens
ASSGDSNQPQH

SEQ ID NO: 960 - protein, 11 aa, Homo sapiens
ASSPGGQETQY

SEQ ID NO: 961 - protein, 9 aa, Homo sapiens
ASSGQETQY

SEQ ID NO: 962 - protein, 10 aa, Homo sapiens
ASSLFTDTQY

SEQ ID NO: 963 - protein, 9 aa, Homo sapiens
ASSLGAEAF

SEQ ID NO: 964 - protein, 9 aa, Homo sapiens
ASSFKETQY

SEQ ID NO: 965 - protein, 11 aa, Homo sapiens
ASSGQGTDTQY

SEQ ID NO: 966 - protein, 9 aa, Homo sapiens
ASSRDTEAF

SEQ ID NO: 967 - protein, 11 aa, Homo sapiens
ASSPGTDYGYT

SEQ ID NO: 968 - protein, 11 aa, Homo sapiens
ASSSGQQETQY

SEQ ID NO: 969 - protein, 11 aa, Homo sapiens
ASSRTGSYEQY

SEQ ID NO: 970 - protein, 12 aa, Homo sapiens
ASSLGGNTGELF

SEQ ID NO: 971 - protein, 9 aa, Homo sapiens
ASSIYNEQF

SEQ ID NO: 972 - protein, 11 aa, Homo sapiens
ASSLGAYNEQF

SEQ ID NO: 973 - protein, 10 aa, Homo sapiens
ASSLGLYEQY

SEQ ID NO: 974 - protein, 12 aa, Homo sapiens
ASSLGRGNTEAF

SEQ ID NO: 975 - protein, 11 aa, Homo sapiens
ASSPDRDQPQH

SEQ ID NO: 976 - protein, 10 aa, Homo sapiens
ASSFRGTEAF

SEQ ID NO: 977 - protein, 10 aa, Homo sapiens
ASSGQGYEQY

SEQ ID NO: 978 - protein, 11 aa, Homo sapiens
ASSRGGNTEAF

SEQ ID NO: 979 - protein, 11 aa, Homo sapiens
ASRGQGNQPQH

SEQ ID NO: 980 - protein, 9 aa, Homo sapiens
ASSLGPEAF

SEQ ID NO: 981 - protein, 12 aa, Homo sapiens
ASSLEGSNQPQH

SEQ ID NO: 982 - protein, 11 aa, Homo sapiens
ASSPTGGTEAF

SEQ ID NO: 983 - protein, 10 aa, Homo sapiens
ASSFRNTEAF

SEQ ID NO: 984 - protein, 11 aa, Homo sapiens
ASSQDRGTEAF

SEQ ID NO: 985 - protein, 12 aa, Homo sapiens
ASSLGRLNTEAF

SEQ ID NO: 986 - protein, 11 aa, Homo sapiens
ASSSPSTDTQY

SEQ ID NO: 987 - protein, 11 aa, Homo sapiens
ASSRQENTEAF

SEQ ID NO: 988 - protein, 9 aa, Homo sapiens
ASSREETQY

SEQ ID NO: 989 - protein, 11 aa, Homo sapiens
ASSLKGNTEAF

SEQ ID NO: 990 - protein, 10 aa, Homo sapiens
ASSPSQETQY

SEQ ID NO: 991 - protein, 9 aa, Homo sapiens
ASSPDYEQY

SEQ ID NO: 992 - protein, 11 aa, Homo sapiens
ASSLGLTDTQY

SEQ ID NO: 993 - protein, 12 aa, Homo sapiens
ASSRTSGTDTQY

SEQ ID NO: 994 - protein, 11 aa, Homo sapiens
ASSRGGTDTQY

SEQ ID NO: 995 - protein, 9 aa, Homo sapiens
ASSPNNEQF

SEQ ID NO: 996 - protein, 11 aa, Homo sapiens
ASSRDRSYEQY

SEQ ID NO: 997 - protein, 12 aa, Homo sapiens
ASSPGQGTYEQY

SEQ ID NO: 998 - protein, 13 aa, Homo sapiens
ASSLGLAGGNEQF

SEQ ID NO: 999 - protein, 10 aa, Homo sapiens
ASSGSSYEQY

SEQ ID NO: 1000 - protein, 11 aa, Homo sapiens
ASSSQGGTEAF

SEQ ID NO: 1001 - protein, 12 aa, Homo sapiens
ASSLGLAADTQY

SEQ ID NO: 1002 - protein, 10 aa, Homo sapiens
ASSSDTDTQY

SEQ ID NO: 1003 - protein, 10 aa, Homo sapiens
ASSLTGDTQY

SEQ ID NO: 1004 - protein, 10 aa, Homo sapiens
ASSFGGYEQY

SEQ ID NO: 1005 - protein, 9 aa, Homo sapiens
ASSSGNEQF

SEQ ID NO: 1006 - protein, 10 aa, Homo sapiens
ASSLSGYGYT

SEQ ID NO: 1007 - protein, 10 aa, Homo sapiens
ASSLTGETQY

SEQ ID NO: 1008 - protein, 11 aa, Homo sapiens
ASSLPGNTEAF

SEQ ID NO: 1009 - protein, 11 aa, Homo sapiens
ASSPGLSYEQY

SEQ ID NO: 1010 - protein, 9 aa, Homo sapiens
ASSSFYEQY

SEQ ID NO: 1011 - protein, 12 aa, Homo sapiens
ASSLSGGNQPQH

SEQ ID NO: 1012 - protein, 13 aa, Homo sapiens
ASSPGLAGTDTQY

SEQ ID NO: 1013 - protein, 11 aa, Homo sapiens
ASSGSSYNEQF

SEQ ID NO: 1014 - protein, 10 aa, Homo sapiens
ASSSGANVLT

SEQ ID NO: 1015 - protein, 11 aa, Homo sapiens
ASSLSANTEAF

SEQ ID NO: 1016 - protein, 9 aa, Homo sapiens
ASSLGSEQY

SEQ ID NO: 1017 - protein, 10 aa, Homo sapiens
ASSLGRNEQF

SEQ ID NO: 1018 - protein, 12 aa, Homo sapiens
ASSSGTGAYEQY

SEQ ID NO: 1019 - protein, 10 aa, Homo sapiens
ASSFNTGELF

SEQ ID NO: 1020 - protein, 11 aa, Homo sapiens
ASSLTPNTEAF

SEQ ID NO: 1021 - protein, 12 aa, Homo sapiens
ASSLSGGNTEAF

SEQ ID NO: 1022 - protein, 10 aa, Homo sapiens
ASSPGNQPQH

SEQ ID NO: 1023 - protein, 10 aa, Homo sapiens
ASSLGNSPLH

SEQ ID NO: 1024 - protein, 12 aa, Homo sapiens
ASSLRQGNQPQH

SEQ ID NO: 1025 - protein, 12 aa, Homo sapiens
ASSPGTGPYEQY

SEQ ID NO: 1026 - protein, 11 aa, Homo sapiens
ASSLGRAYEQY

SEQ ID NO: 1027 - protein, 9 aa, Homo sapiens
ASSSGTEAF

SEQ ID NO: 1028 - protein, 13 aa, Homo sapiens
ASSLGGSGANVLT

SEQ ID NO: 1029 - protein, 10 aa, Homo sapiens
ASSLTGTEAF

SEQ ID NO: 1030 - protein, 9 aa, Homo sapiens
ASSSNQPQH

SEQ ID NO: 1031 - protein, 11 aa, Homo sapiens
ASSFSGTDTQY

SEQ ID NO: 1032 - protein, 12 aa, Homo sapiens
ASSPGTSGYEQY

SEQ ID NO: 1033 - protein, 11 aa, Homo sapiens
ASSLDGTDTQY

SEQ ID NO: 1034 - protein, 10 aa, Homo sapiens
ASSPTSYEQY

SEQ ID NO: 1035 - protein, 10 aa, Homo sapiens
ASSLEGNEQF

SEQ ID NO: 1036 - protein, 12 aa, Homo sapiens
ASSLQGGNTEAF

SEQ ID NO: 1037 - protein, 11 aa, Homo sapiens
ASSRQGTDTQY

SEQ ID NO: 1038 - protein, 10 aa, Homo sapiens
ASSSGYNEQF

SEQ ID NO: 1039 - protein, 11 aa, Homo sapiens
ASSLDRYNEQF

SEQ ID NO: 1040 - protein, 12 aa, Homo sapiens
ASSPGQGYNEQF

SEQ ID NO: 1041 - protein, 12 aa, Homo sapiens
ASSLGQTNTEAF

SEQ ID NO: 1042 - protein, 11 aa, Homo sapiens
ASSPGLYNEQF

SEQ ID NO: 1043 - protein, 11 aa, Homo sapiens
ASSLQLNTEAF

SEQ ID NO: 1044 - protein, 10 aa, Homo sapiens
ASSPRGNEQF

SEQ ID NO: 1045 - protein, 12 aa, Homo sapiens
ASSPRDSSYEQY

SEQ ID NO: 1046 - protein, 9 aa, Homo sapiens
ASSSGYGYT

SEQ ID NO: 1047 - protein, 12 aa, Homo sapiens
ASSLTGSGNTIY

SEQ ID NO: 1048 - protein, 12 aa, Homo sapiens
ASSFGGSSYEQY

SEQ ID NO: 1049 - protein, 12 aa, Homo sapiens
ASSLLAGTDTQY

SEQ ID NO: 1050 - protein, 11 aa, Homo sapiens
ASSLGGPDTQY

SEQ ID NO: 1051 - protein, 12 aa, Homo sapiens
ASSLGLGTDTQY

SEQ ID NO: 1052 - protein, 11 aa, Homo sapiens
ASSPQGGTEAF

SEQ ID NO: 1053 - protein, 12 aa, Homo sapiens
ASSLQGSTDTQY

SEQ ID NO: 1054 - protein, 12 aa, Homo sapiens
ASSLAGATDTQY

SEQ ID NO: 1055 - protein, 11 aa, Homo sapiens
ASSLGRGYEQY

SEQ ID NO: 1056 - protein, 14 aa, Homo sapiens
ASSLGLAGGTDTQY

SEQ ID NO: 1057 - protein, 11 aa, Homo sapiens
ASSLEANTEAF

SEQ ID NO: 1058 - protein, 12 aa, Homo sapiens
ASSLQGSGNTIY

SEQ ID NO: 1059 - protein, 9 aa, Homo sapiens
ASSDQETQY

SEQ ID NO: 1060 - protein, 11 aa, Homo sapiens
ASSFGGGTEAF

SEQ ID NO: 1061 - protein, 11 aa, Homo sapiens
ASSPGPSYEQY

SEQ ID NO: 1062 - protein, 11 aa, Homo sapiens
ASRGQGNTEAF

SEQ ID NO: 1063 - protein, 11 aa, Homo sapiens
ASSLGTTDTQY

SEQ ID NO: 1064 - protein, 10 aa, Homo sapiens
ASSLGDYGYT

SEQ ID NO: 1065 - protein, 12 aa, Homo sapiens
ASSLRGSGNTIY

SEQ ID NO: 1066 - protein, 10 aa, Homo sapiens
ASSFGSYEQY

SEQ ID NO: 1067 - protein, 12 aa, Homo sapiens
ASSLGQGYNEQF

SEQ ID NO: 1068 - protein, 12 aa, Homo sapiens
ASSPQGSNQPQH

SEQ ID NO: 1069 - protein, 11 aa, Homo sapiens
ASSRTGNQPQH

SEQ ID NO: 1070 - protein, 12 aa, Homo sapiens
ASSLGQGGYEQY

SEQ ID NO: 1071 - protein, 12 aa, Homo sapiens
ASSPTGSNQPQH

SEQ ID NO: 1072 - protein, 10 aa, Homo sapiens
ASSLGRYEQY

SEQ ID NO: 1073 - protein, 12 aa, Homo sapiens
ASSSGQGAYEQY

SEQ ID NO: 1074 - protein, 11 aa, Homo sapiens
ASSRQGGTEAF

SEQ ID NO: 1075 - protein, 10 aa, Homo sapiens
ASSLGDYEQY

SEQ ID NO: 1076 - protein, 11 aa, Homo sapiens
ASSPDSSYEQY

SEQ ID NO: 1077 - protein, 10 aa, Homo sapiens
ASSYRGTEAF

SEQ ID NO: 1078 - protein, 11 aa, Homo sapiens
ASSLGDSYEQY

SEQ ID NO: 1079 - protein, 12 aa, Homo sapiens
ASSRTSGSYEQY

SEQ ID NO: 1080 - protein, 9 aa, Homo sapiens
ASSLRGEQY

SEQ ID NO: 1081 - protein, 11 aa, Homo sapiens
ASSRGGNQPQH

SEQ ID NO: 1082 - protein, 11 aa, Homo sapiens
ASSLTGDYGYT

SEQ ID NO: 1083 - protein, 10 aa, Homo sapiens
ASSYSGYEQY

SEQ ID NO: 1084 - protein, 9 aa, Homo sapiens
ASSQGGEQY

SEQ ID NO: 1085 - protein, 11 aa, Homo sapiens
ASSLAGDTEAF

SEQ ID NO: 1086 - protein, 10 aa, Homo sapiens
ASSYSGETQY

SEQ ID NO: 1087 - protein, 9 aa, Homo sapiens
ASSPSETQY

SEQ ID NO: 1088 - protein, 11 aa, Homo sapiens
ASSSGQSYEQY

SEQ ID NO: 1089 - protein, 11 aa, Homo sapiens
ASSYGQNTEAF

SEQ ID NO: 1090 - protein, 11 aa, Homo sapiens
ASSFGQGYEQY

SEQ ID NO: 1091 - protein, 12 aa, Homo sapiens
ASSRQGSNQPQH

SEQ ID NO: 1092 - protein, 12 aa, Homo sapiens
ASSPGGSNQPQH

SEQ ID NO: 1093 - protein, 12 aa, Homo sapiens
ASSLGTGTYEQY

SEQ ID NO: 1094 - protein, 9 aa, Homo sapiens
ASSFLDTQY

SEQ ID NO: 1095 - protein, 11 aa, Homo sapiens
ASSLRSSYEQY

SEQ ID NO: 1096 - protein, 13 aa, Homo sapiens
ASSFSGSSYNEQF

SEQ ID NO: 1097 - protein, 12 aa, Homo sapiens
ASSPGGGTDTQY

SEQ ID NO: 1098 - protein, 10 aa, Homo sapiens
ASRQGNQPQH

SEQ ID NO: 1099 - protein, 11 aa, Homo sapiens
ASSLTGAYEQY

SEQ ID NO: 1100 - protein, 10 aa, Homo sapiens
ASSFPNQPQH

SEQ ID NO: 1101 - protein, 12 aa, Homo sapiens
ASSLDRGSYEQY

SEQ ID NO: 1102 - protein, 12 aa, Homo sapiens
ASSSTGGNQPQH

SEQ ID NO: 1103 - protein, 11 aa, Homo sapiens
ASSLGGEETQY

SEQ ID NO: 1104 - protein, 11 aa, Homo sapiens
ASSLVGQETQY

SEQ ID NO: 1105 - protein, 11 aa, Homo sapiens
ASSRDREETQY

SEQ ID NO: 1106 - protein, 10 aa, Homo sapiens
ASSYRNTEAF

SEQ ID NO: 1107 - protein, 11 aa, Homo sapiens
ASSLGATDTQY

SEQ ID NO: 1108 - protein, 11 aa, Homo sapiens
ASSLTSSYEQY

SEQ ID NO: 1109 - protein, 11 aa, Homo sapiens
ASSLDRGQPQH

SEQ ID NO: 1110 - protein, 11 aa, Homo sapiens
ASSLDRQETQY

SEQ ID NO: 1111 - protein, 10 aa, Homo sapiens
ASSLSPDTQY

SEQ ID NO: 1112 - protein, 11 aa, Homo sapiens
ASSLSGYNEQF

SEQ ID NO: 1113 - protein, 11 aa, Homo sapiens
ASSLGQGETQY

SEQ ID NO: 1114 - protein, 11 aa, Homo sapiens
ASSQTGNTEAF

SEQ ID NO: 1115 - protein, 10 aa, Homo sapiens
ASSRGNQPQH

SEQ ID NO: 1116 - protein, 11 aa, Homo sapiens
ASSPDGNYGYT

SEQ ID NO: 1117 - protein, 9 aa, Homo sapiens
ASSGGTEAF

SEQ ID NO: 1118 - protein, 13 aa, Homo sapiens
ASSLAGGSTDTQY

SEQ ID NO: 1119 - protein, 11 aa, Homo sapiens
ASSLLGGTEAF

SEQ ID NO: 1120 - protein, 9 aa, Homo sapiens
ASSQGYGYT

SEQ ID NO: 1121 - protein, 12 aa, Homo sapiens
ASSSGTANTEAF

SEQ ID NO: 1122 - protein, 11 aa, Homo sapiens
ASSGTVNTEAF

SEQ ID NO: 1123 - protein, 11 aa, Homo sapiens
ASSLTGGYGYT

SEQ ID NO: 1124 - protein, 10 aa, Homo sapiens
ASSQNTGELF

SEQ ID NO: 1125 - protein, 11 aa, Homo sapiens
ASSFGENTEAF

SEQ ID NO: 1126 - protein, 12 aa, Homo sapiens
ASSLAASTDTQY

SEQ ID NO: 1127 - protein, 10 aa, Homo sapiens
ASSSPNQPQH

SEQ ID NO: 1128 - protein, 10 aa, Homo sapiens
ASSQGPYEQY

SEQ ID NO: 1129 - protein, 11 aa, Homo sapiens
ASSLARTDTQY

SEQ ID NO: 1130 - protein, 10 aa, Homo sapiens
ASSGDSYEQY

SEQ ID NO: 1131 - protein, 12 aa, Homo sapiens
ASSLDSSNQPQH

SEQ ID NO: 1132 - protein, 9 aa, Homo sapiens
ASSFSNEQF

SEQ ID NO: 1133 - protein, 10 aa, Homo sapiens
ASSLGSYGYT

SEQ ID NO: 1134 - protein, 11 aa, Homo sapiens
ASSLSGGYEQY

SEQ ID NO: 1135 - protein, 11 aa, Homo sapiens
ASSLGGRTEAF

SEQ ID NO: 1136 - protein, 9 aa, Homo sapiens
ASRGTDTQY

SEQ ID NO: 1137 - protein, 11 aa, Homo sapiens
ASSLDRDYGYT

SEQ ID NO: 1138 - protein, 11 aa, Homo sapiens
ASSRDRNQPQH

SEQ ID NO: 1139 - protein, 10 aa, Homo sapiens
ASSLAYNEQF

SEQ ID NO: 1140 - protein, 12 aa, Homo sapiens
ASSLTGANTEAF

SEQ ID NO: 1141 - protein, 10 aa, Homo sapiens
ASSRDTDTQY

SEQ ID NO: 1142 - protein, 11 aa, Homo sapiens
ASSLQGYTEAF

SEQ ID NO: 1143 - protein, 9 aa, Homo sapiens
ASRVNTEAF

SEQ ID NO: 1144 - protein, 11 aa, Homo sapiens
ASSLAGGDTQY

SEQ ID NO: 1145 - protein, 10 aa, Homo sapiens
ASSQGGNEQF

SEQ ID NO: 1146 - protein, 11 aa, Homo sapiens
ASSPQGNYGYT

SEQ ID NO: 1147 - protein, 11 aa, Homo sapiens
ASSPGPYNEQF

SEQ ID NO: 1148 - protein, 11 aa, Homo sapiens
ASSLSGNYGYT

SEQ ID NO: 1149 - protein, 11 aa, Homo sapiens
ASSFGMNTEAF

SEQ ID NO: 1150 - protein, 10 aa, Homo sapiens
ASRTGGTEAF

SEQ ID NO: 1151 - protein, 11 aa, Homo sapiens
ASSRQGSYEQY

SEQ ID NO: 1152 - protein, 12 aa, Homo sapiens
ASSSGTGGYEQY

SEQ ID NO: 1153 - protein, 9 aa, Homo sapiens
ASSEQETQY

SEQ ID NO: 1154 - protein, 9 aa, Homo sapiens
ASSHQETQY

SEQ ID NO: 1155 - protein, 9 aa, Homo sapiens
ASSRADTQY

SEQ ID NO: 1156 - protein, 12 aa, Homo sapiens
ASSYSSGANVLT

SEQ ID NO: 1157 - protein, 11 aa, Homo sapiens
ASSPDRDYGYT

SEQ ID NO: 1158 - protein, 11 aa, Homo sapiens
ASSSGQNYGYT

SEQ ID NO: 1159 - protein, 13 aa, Homo sapiens
ASSPGLAGYNEQF

SEQ ID NO: 1160 - protein, 13 aa, Homo sapiens
ASSSGTSGYNEQF

SEQ ID NO: 1161 - protein, 10 aa, Homo sapiens
ASSLLQETQY

SEQ ID NO: 1162 - protein, 10 aa, Homo sapiens
ASSQGNYGYT

SEQ ID NO: 1163 - protein, 10 aa, Homo sapiens
ASSPQGTEAF

SEQ ID NO: 1164 - protein, 11 aa, Homo sapiens
ASSGQMNTEAF

SEQ ID NO: 1165 - protein, 11 aa, Homo sapiens
ASSLSQNTEAF

SEQ ID NO: 1166 - protein, 10 aa, Homo sapiens
ASSLGLDTQY

SEQ ID NO: 1167 - protein, 9 aa, Homo sapiens
ASSSYTEAF

SEQ ID NO: 1168 - protein, 10 aa, Homo sapiens
ASSLANQPQH

SEQ ID NO: 1169 - protein, 10 aa, Homo sapiens
ASSPSGNTIY

SEQ ID NO: 1170 - protein, 13 aa, Homo sapiens
ASSLGQGGNQPQH

SEQ ID NO: 1171 - protein, 10 aa, Homo sapiens
ASSRQNTEAF

SEQ ID NO: 1172 - protein, 11 aa, Homo sapiens
ASSLTANYGYT

SEQ ID NO: 1173 - protein, 10 aa, Homo sapiens
ASSLTGNTIY

SEQ ID NO: 1174 - protein, 12 aa, Homo sapiens
ASSLAGGTYEQY

SEQ ID NO: 1175 - protein, 10 aa, Homo sapiens
ASSTGGTEAF

SEQ ID NO: 1176 - protein, 11 aa, Homo sapiens
ASSLQGSTEAF

SEQ ID NO: 1177 - protein, 11 aa, Homo sapiens
ASSPNSNQPQH

SEQ ID NO: 1178 - protein, 10 aa, Homo sapiens
ASSQGADTQY

SEQ ID NO: 1179 - protein, 10 aa, Homo sapiens
ASRTGNTEAF

SEQ ID NO: 1180 - protein, 10 aa, Homo sapiens
ASSLGVTEAF

SEQ ID NO: 1181 - protein, 9 aa, Homo sapiens
ASSQNYEQY

SEQ ID NO: 1182 - protein, 10 aa, Homo sapiens
ASSLVYNEQF

SEQ ID NO: 1183 - protein, 11 aa, Homo sapiens
ASSSTSTDTQY

SEQ ID NO: 1184 - protein, 11 aa, Homo sapiens
ASSPSSTDTQY

SEQ ID NO: 1185 - protein, 10 aa, Homo sapiens
ASSLGEETQY

SEQ ID NO: 1186 - protein, 11 aa, Homo sapiens
ASSLDREETQY

SEQ ID NO: 1187 - protein, 12 aa, Homo sapiens
ASSLGGRNTEAF

SEQ ID NO: 1188 - protein, 10 aa, Homo sapiens
ASSLPTDTQY

SEQ ID NO: 1189 - protein, 12 aa, Homo sapiens
ASSSSGSTDTQY

SEQ ID NO: 1190 - protein, 9 aa, Homo sapiens
ASSVNTEAF

SEQ ID NO: 1191 - protein, 12 aa, Homo sapiens
ASSLEGGNQPQH

SEQ ID NO: 1192 - protein, 13 aa, Homo sapiens
ASSLGTGGNQPQH

SEQ ID NO: 1193 - protein, 10 aa, Homo sapiens
ASSLDGYGYT

SEQ ID NO: 1194 - protein, 10 aa, Homo sapiens
ASSRMNTEAF

SEQ ID NO: 1195 - protein, 12 aa, Homo sapiens
ASSPTGLNTEAF

SEQ ID NO: 1196 - protein, 12 aa, Homo sapiens
ASSPGQGGTEAF

SEQ ID NO: 1197 - protein, 11 aa, Homo sapiens
ASSVQGNTEAF

SEQ ID NO: 1198 - protein, 10 aa, Homo sapiens
ASSLTGYGYT

SEQ ID NO: 1199 - protein, 12 aa, Homo sapiens
ASSLAGRTDTQY

SEQ ID NO: 1200 - protein, 11 aa, Homo sapiens
ASSLGQNYEQY

SEQ ID NO: 1201 - protein, 10 aa, Homo sapiens
ASSSFTDTQY

SEQ ID NO: 1202 - protein, 10 aa, Homo sapiens
ASSLSRETQY

SEQ ID NO: 1203 - protein, 9 aa, Homo sapiens
ASSNYNEQF

SEQ ID NO: 1204 - protein, 12 aa, Homo sapiens
ASSLAGGADTQY

SEQ ID NO: 1205 - protein, 10 aa, Homo sapiens
ASSSGTYEQY

SEQ ID NO: 1206 - protein, 10 aa, Homo sapiens
ASSSGPYEQY

SEQ ID NO: 1207 - protein, 11 aa, Homo sapiens
ASSLGTGYGYT

SEQ ID NO: 1208 - protein, 11 aa, Homo sapiens
ASSLRGADTQY

SEQ ID NO: 1209 - protein, 11 aa, Homo sapiens
ASSPGLAYEQY

SEQ ID NO: 1210 - protein, 13 aa, Homo sapiens
ASSGTSGSTDTQY

SEQ ID NO: 1211 - protein, 12 aa, Homo sapiens
ASSLGLAGNEQF

SEQ ID NO: 1212 - protein, 10 aa, Homo sapiens
ASSQVGETQY

SEQ ID NO: 1213 - protein, 12 aa, Homo sapiens
ASSPRQGNTEAF

SEQ ID NO: 1214 - protein, 10 aa, Homo sapiens
ASSQGYNEQF

SEQ ID NO: 1215 - protein, 10 aa, Homo sapiens
ASSLSPYEQY

SEQ ID NO: 1216 - protein, 9 aa, Homo sapiens
ASSRNNEQF

SEQ ID NO: 1217 - protein, 12 aa, Homo sapiens
ASSLGLAGYEQY

SEQ ID NO: 1218 - protein, 11 aa, Homo sapiens
ASSLGTDYGYT

SEQ ID NO: 1219 - protein, 11 aa, Homo sapiens
ASSLAPNTEAF

SEQ ID NO: 1220 - protein, 12 aa, Homo sapiens
ASSLSGGSYEQY

SEQ ID NO: 1221 - protein, 11 aa, Homo sapiens
ASSLGASYEQY

SEQ ID NO: 1222 - protein, 8 aa, Homo sapiens
ASSRETQY

SEQ ID NO: 1223 - protein, 12 aa, Homo sapiens
ASSPGGSTDTQY

SEQ ID NO: 1224 - protein, 9 aa, Homo sapiens
ASSSDYEQY

SEQ ID NO: 1225 - protein, 9 aa, Homo sapiens
ASSPGGEQY

SEQ ID NO: 1226 - protein, 10 aa, Homo sapiens
ASRGSTDTQY

SEQ ID NO: 1227 - protein, 11 aa, Homo sapiens
ASSPGSQETQY

SEQ ID NO: 1228 - protein, 12 aa, Homo sapiens
ASSLVGGNQPQH

SEQ ID NO: 1229 - protein, 9 aa, Homo sapiens
ASSGNTEAF

SEQ ID NO: 1230 - protein, 10 aa, Homo sapiens
ASRGSNQPQH

SEQ ID NO: 1231 - protein, 11 aa, Homo sapiens
ASSPSGTDTQY

SEQ ID NO: 1232 - protein, 11 aa, Homo sapiens
ASSRGSNQPQH

SEQ ID NO: 1233 - protein, 9 aa, Homo sapiens
ASTLNTEAF

SEQ ID NO: 1234 - protein, 13 aa, Homo sapiens
ASSLTGSSYNEQF

SEQ ID NO: 1235 - protein, 10 aa, Homo sapiens
ASSPLGETQY

SEQ ID NO: 1236 - protein, 11 aa, Homo sapiens
ASSSGGNTEAF

SEQ ID NO: 1237 - protein, 12 aa, Homo sapiens
ASSLRGMNTEAF

SEQ ID NO: 1238 - protein, 12 aa, Homo sapiens
ASSLRQGNTEAF

SEQ ID NO: 1239 - protein, 11 aa, Homo sapiens
ASSLDTNTEAF

SEQ ID NO: 1240 - protein, 11 aa, Homo sapiens
ASSRGSTDTQY

SEQ ID NO: 1241 - protein, 11 aa, Homo sapiens
ASSWDRNTEAF

SEQ ID NO: 1242 - protein, 11 aa, Homo sapiens
ASSRGQNTEAF

SEQ ID NO: 1243 - protein, 8 aa, Homo sapiens
ASSSYEQY

SEQ ID NO: 1244 - protein, 13 aa, Homo sapiens
ASSPTSGSYNEQF

SEQ ID NO: 1245 - protein, 11 aa, Homo sapiens
ASSSGGNQPQH

SEQ ID NO: 1246 - protein, 9 aa, Homo sapiens
ASRRTDTQY

SEQ ID NO: 1247 - protein, 11 aa, Homo sapiens
ASSWTGNTEAF

SEQ ID NO: 1248 - protein, 10 aa, Homo sapiens
ASSPDSYGYT

SEQ ID NO: 1249 - protein, 10 aa, Homo sapiens
ASSGGNQPQH

SEQ ID NO: 1250 - protein, 11 aa, Homo sapiens
ASSLEQNTEAF

SEQ ID NO: 1251 - protein, 11 aa, Homo sapiens
ASSLAGPYEQY

SEQ ID NO: 1252 - protein, 11 aa, Homo sapiens
ASSLGLNNEQF

SEQ ID NO: 1253 - protein, 10 aa, Homo sapiens
ASSLVNQPQH

SEQ ID NO: 1254 - protein, 9 aa, Homo sapiens
ASSVGETQY

SEQ ID NO: 1255 - protein, 12 aa, Homo sapiens
ASSLDRLNTEAF

SEQ ID NO: 1256 - protein, 10 aa, Homo sapiens
ASSQGGETQY

SEQ ID NO: 1257 - protein, 11 aa, Homo sapiens
ASSRDRGETQY

SEQ ID NO: 1258 - protein, 11 aa, Homo sapiens
ASSFGGQETQY

SEQ ID NO: 1259 - protein, 9 aa, Homo sapiens
ASRSSYEQY

SEQ ID NO: 1260 - protein, 10 aa, Homo sapiens
ASSLPQETQY

SEQ ID NO: 1261 - protein, 11 aa, Homo sapiens
ASSPGPNQPQH

SEQ ID NO: 1262 - protein, 12 aa, Homo sapiens
ASSFSGGTDTQY

SEQ ID NO: 1263 - protein, 9 aa, Homo sapiens
ASRGYNEQF

SEQ ID NO: 1264 - protein, 11 aa, Homo sapiens
ASSQDLGQPQH

SEQ ID NO: 1265 - protein, 11 aa, Homo sapiens
ASSPGTYNEQF

SEQ ID NO: 1266 - protein, 12 aa, Homo sapiens
ASSLGQPNTEAF

SEQ ID NO: 1267 - protein, 9 aa, Homo sapiens
ASSLDETQY

SEQ ID NO: 1268 - protein, 11 aa, Homo sapiens
ASSLDGSYEQY

SEQ ID NO: 1269 - protein, 11 aa, Homo sapiens
ASSPRGGTEAF

SEQ ID NO: 1270 - protein, 12 aa, Homo sapiens
ASSLSGSGNTIY

SEQ ID NO: 1271 - protein, 9 aa, Homo sapiens
ASSLGSEAF

SEQ ID NO: 1272 - protein, 11 aa, Homo sapiens
ASSLEGNYGYT

SEQ ID NO: 1273 - protein, 9 aa, Homo sapiens
ASSLAGELF

SEQ ID NO: 1274 - protein, 12 aa, Homo sapiens
ASSRTGSNQPQH

SEQ ID NO: 1275 - protein, 11 aa, Homo sapiens
ASSLQGADTQY

SEQ ID NO: 1276 - protein, 9 aa, Homo sapiens
ASSLVDEQF

SEQ ID NO: 1277 - protein, 11 aa, Homo sapiens
ASSSRGNTEAF

SEQ ID NO: 1278 - protein, 10 aa, Homo sapiens
ASSFGGNEQF

SEQ ID NO: 1279 - protein, 10 aa, Homo sapiens
ASSPRADTQY

SEQ ID NO: 1280 - protein, 10 aa, Homo sapiens
ASSISTDTQY

SEQ ID NO: 1281 - protein, 11 aa, Homo sapiens
ASSLVQNTEAF

SEQ ID NO: 1282 - protein, 11 aa, Homo sapiens
ASSQGPNTEAF

SEQ ID NO: 1283 - protein, 10 aa, Homo sapiens
ASSPGGYGYT

SEQ ID NO: 1284 - protein, 11 aa, Homo sapiens
ASSLGREETQY

SEQ ID NO: 1285 - protein, 11 aa, Homo sapiens
ASSSGSNQPQH

SEQ ID NO: 1286 - protein, 11 aa, Homo sapiens
ASSWTVNTEAF

SEQ ID NO: 1287 - protein, 12 aa, Homo sapiens
ASSLRGGNTEAF

SEQ ID NO: 1288 - protein, 10 aa, Homo sapiens
ASSLRDTEAF

SEQ ID NO: 1289 - protein, 10 aa, Homo sapiens
ASSLRYNEQF

SEQ ID NO: 1290 - protein, 12 aa, Homo sapiens
ASSLGLAEETQY

SEQ ID NO: 1291 - protein, 9 aa, Homo sapiens
ASSGAYEQY

SEQ ID NO: 1292 - protein, 10 aa, Homo sapiens
ASSRLNTEAF

SEQ ID NO: 1293 - protein, 10 aa, Homo sapiens
ASSLGDNEQF

SEQ ID NO: 1294 - protein, 11 aa, Homo sapiens
ASSRDSNYGYT

SEQ ID NO: 1295 - protein, 13 aa, Homo sapiens
ASSLGTSGTDTQY

SEQ ID NO: 1296 - protein, 9 aa, Homo sapiens
ASSPLNEQF

SEQ ID NO: 1297 - protein, 11 aa, Homo sapiens
ASSRDRDQPQH

SEQ ID NO: 1298 - protein, 11 aa, Homo sapiens
ASSPTANTEAF

SEQ ID NO: 1299 - protein, 11 aa, Homo sapiens
ASSQDLNQPQH

SEQ ID NO: 1300 - protein, 11 aa, Homo sapiens
ASSSRGTDTQY

SEQ ID NO: 1301 - protein, 12 aa, Homo sapiens
ASSLVGSSYEQY

SEQ ID NO: 1302 - protein, 11 aa, Homo sapiens
ASSLGYQETQY

SEQ ID NO: 1303 - protein, 12 aa, Homo sapiens
ASSPSGGTDTQY

SEQ ID NO: 1304 - protein, 9 aa, Homo sapiens
ASSLRDEQF

SEQ ID NO: 1305 - protein, 11 aa, Homo sapiens
ASSLQGQETQY

SEQ ID NO: 1306 - protein, 11 aa, Homo sapiens
ASSPGPQETQY

SEQ ID NO: 1307 - protein, 11 aa, Homo sapiens
ASSYGGNQPQH

SEQ ID NO: 1308 - protein, 11 aa, Homo sapiens
ASSEQGNTEAF

SEQ ID NO: 1309 - protein, 10 aa, Homo sapiens
ASSRSNQPQH

SEQ ID NO: 1310 - protein, 11 aa, Homo sapiens
ASSQGSTDTQY

SEQ ID NO: 1311 - protein, 11 aa, Homo sapiens
ASSYSRNTEAF

SEQ ID NO: 1312 - protein, 9 aa, Homo sapiens
ASSLGGGYT

SEQ ID NO: 1313 - protein, 11 aa, Homo sapiens
ASSQDLNTEAF

SEQ ID NO: 1314 - protein, 11 aa, Homo sapiens
ASSRGQQETQY

SEQ ID NO: 1315 - protein, 12 aa, Homo sapiens
ASSSGTVNTEAF

SEQ ID NO: 1316 - protein, 12 aa, Homo sapiens
ASSLEGSTDTQY

SEQ ID NO: 1317 - protein, 11 aa, Homo sapiens
ASSLQGAYEQY

SEQ ID NO: 1318 - protein, 9 aa, Homo sapiens
ASSRDYEQY

SEQ ID NO: 1319 - protein, 12 aa, Homo sapiens
ASRLAGGTDTQY

SEQ ID NO: 1320 - protein, 12 aa, Homo sapiens
ASSLGTGQETQY

SEQ ID NO: 1321 - protein, 11 aa, Homo sapiens
ASSLVMNTEAF

SEQ ID NO: 1322 - protein, 11 aa, Homo sapiens
ASSLGLADTQY

SEQ ID NO: 1323 - protein, 13 aa, Homo sapiens
ASSPLAGGYNEQF

SEQ ID NO: 1324 - protein, 10 aa, Homo sapiens
ASSLRGYGYT

SEQ ID NO: 1325 - protein, 11 aa, Homo sapiens
ASSLGVYNEQF

SEQ ID NO: 1326 - protein, 10 aa, Homo sapiens
ASSWGNTEAF

SEQ ID NO: 1327 - protein, 10 aa, Homo sapiens
ASSRDSYGYT

SEQ ID NO: 1328 - protein, 10 aa, Homo sapiens
ASSLPNTEAF

SEQ ID NO: 1329 - protein, 12 aa, Homo sapiens
ASSSGQLNTEAF

SEQ ID NO: 1330 - protein, 11 aa, Homo sapiens
ASSRGMNTEAF

SEQ ID NO: 1331 - protein, 10 aa, Homo sapiens
ASSWGTDTQY

SEQ ID NO: 1332 - protein, 11 aa, Homo sapiens
ASSLGGGYGYT

SEQ ID NO: 1333 - protein, 10 aa, Homo sapiens
ASSFRTDTQY

SEQ ID NO: 1334 - protein, 10 aa, Homo sapiens
ASSPLGDTQY

SEQ ID NO: 1335 - protein, 12 aa, Homo sapiens
ASSLGGGYNEQF

SEQ ID NO: 1336 - protein, 11 aa, Homo sapiens
ASSLDRGETQY

SEQ ID NO: 1337 - protein, 12 aa, Homo sapiens
ASSLDGSTDTQY

SEQ ID NO: 1338 - protein, 11 aa, Homo sapiens
ASSYGRNTEAF

SEQ ID NO: 1339 - protein, 12 aa, Homo sapiens
ASSLDSSGNTIY

SEQ ID NO: 1340 - protein, 11 aa, Homo sapiens
ASSLTSYNEQF

SEQ ID NO: 1341 - protein, 10 aa, Homo sapiens
ASSRVNTEAF

SEQ ID NO: 1342 - protein, 12 aa, Homo sapiens
ASSLRGGNQPQH

SEQ ID NO: 1343 - protein, 11 aa, Homo sapiens
ASSRTSTDTQY

SEQ ID NO: 1344 - protein, 11 aa, Homo sapiens
ASSRTVQETQY

SEQ ID NO: 1345 - protein, 13 aa, Homo sapiens
ASSLDRGSYNEQF

SEQ ID NO: 1346 - protein, 9 aa, Homo sapiens
ASSLVGEQY

SEQ ID NO: 1347 - protein, 12 aa, Homo sapiens
ASSSSGGTDTQY

SEQ ID NO: 1348 - protein, 11 aa, Homo sapiens
ASSWDSSYEQY

SEQ ID NO: 1349 - protein, 12 aa, Homo sapiens
ASSPGQGADTQY

SEQ ID NO: 1350 - protein, 10 aa, Homo sapiens
ASSSGADTQY

SEQ ID NO: 1351 - protein, 10 aa, Homo sapiens
ASSEGNQPQH

SEQ ID NO: 1352 - protein, 12 aa, Homo sapiens
ASSRTGGTDTQY

SEQ ID NO: 1353 - protein, 11 aa, Homo sapiens
ASSLGTQETQY

SEQ ID NO: 1354 - protein, 10 aa, Homo sapiens
ASSLYTGELF

SEQ ID NO: 1355 - protein, 9 aa, Homo sapiens
ASSLSGEQY

SEQ ID NO: 1356 - protein, 10 aa, Homo sapiens
ASSLAPDTQY

SEQ ID NO: 1357 - protein, 10 aa, Homo sapiens
ASSSTSYEQY

SEQ ID NO: 1358 - protein, 11 aa, Homo sapiens
ASSPTGDYGYT

SEQ ID NO: 1359 - protein, 11 aa, Homo sapiens
ASSLGQGNEQF

SEQ ID NO: 1360 - protein, 13 aa, Homo sapiens
ASSLGQGSNQPQH

SEQ ID NO: 1361 - protein, 9 aa, Homo sapiens
ASSLVGEQF

SEQ ID NO: 1362 - protein, 12 aa, Homo sapiens
ASSPTGMNTEAF

SEQ ID NO: 1363 - protein, 12 aa, Homo sapiens
ASSRQGGNQPQH

SEQ ID NO: 1364 - protein, 10 aa, Homo sapiens
ASSLGNYGYT

SEQ ID NO: 1365 - protein, 11 aa, Homo sapiens
ASSPDSTDTQY

SEQ ID NO: 1366 - protein, 12 aa, Homo sapiens
ASSLRDSNQPQH

SEQ ID NO: 1367 - protein, 12 aa, Homo sapiens
ASSFGGGTDTQY

SEQ ID NO: 1368 - protein, 9 aa, Homo sapiens
ASSYLETQY

SEQ ID NO: 1369 - protein, 12 aa, Homo sapiens
ASSSGTSTDTQY

SEQ ID NO: 1370 - protein, 13 aa, Homo sapiens
ASSRTSGSTDTQY

SEQ ID NO: 1371 - protein, 12 aa, Homo sapiens
ASSPGQSNQPQH

SEQ ID NO: 1372 - protein, 12 aa, Homo sapiens
ASSFGTGSYEQY

SEQ ID NO: 1373 - protein, 12 aa, Homo sapiens
ASSLRGSYNEQF

SEQ ID NO: 1374 - protein, 10 aa, Homo sapiens
ASSDSTDTQY

SEQ ID NO: 1375 - protein, 10 aa, Homo sapiens
ASSPDYNEQF

SEQ ID NO: 1376 - protein, 12 aa, Homo sapiens
ASSLGTGPYEQY

SEQ ID NO: 1377 - protein, 12 aa, Homo sapiens
ASSPGTAQETQY

SEQ ID NO: 1378 - protein, 10 aa, Homo sapiens
ASSLVPYEQY

SEQ ID NO: 1379 - protein, 10 aa, Homo sapiens
ASSPYTGELF

SEQ ID NO: 1380 - protein, 11 aa, Homo sapiens
ASSPSMNTEAF

SEQ ID NO: 1381 - protein, 10 aa, Homo sapiens
ASSLGGAEAF

SEQ ID NO: 1382 - protein, 11 aa, Homo sapiens
ASSYRGNQPQH

SEQ ID NO: 1383 - protein, 11 aa, Homo sapiens
ASSGGSTDTQY

SEQ ID NO: 1384 - protein, 9 aa, Homo sapiens
ASSLGYEQF

SEQ ID NO: 1385 - protein, 10 aa, Homo sapiens
ASSFSYNEQF

SEQ ID NO: 1386 - protein, 11 aa, Homo sapiens
ASSLLVNTEAF

SEQ ID NO: 1387 - protein, 11 aa, Homo sapiens
ASSGTGNTEAF

SEQ ID NO: 1388 - protein, 10 aa, Homo sapiens
ASSESTDTQY

SEQ ID NO: 1389 - protein, 13 aa, Homo sapiens
ASSLSGGSYNEQF

SEQ ID NO: 1390 - protein, 12 aa, Homo sapiens
ASSLRTGNTEAF

SEQ ID NO: 1391 - protein, 11 aa, Homo sapiens
ASSPQGTDTQY

SEQ ID NO: 1392 - protein, 11 aa, Homo sapiens
ASSLSNTGELF

SEQ ID NO: 1393 - protein, 11 aa, Homo sapiens
ASSYSGANVLT

SEQ ID NO: 1394 - protein, 11 aa, Homo sapiens
ASSLAMNTEAF

SEQ ID NO: 1395 - protein, 12 aa, Homo sapiens
ASSLDSLNTEAF

SEQ ID NO: 1396 - protein, 11 aa, Homo sapiens
ASSPGTAYGYT

SEQ ID NO: 1397 - protein, 10 aa, Homo sapiens
ASSPFTDTQY

SEQ ID NO: 1398 - protein, 11 aa, Homo sapiens
ASSPTGTDTQY

SEQ ID NO: 1399 - protein, 9 aa, Homo sapiens
ASSYGDTQY

SEQ ID NO: 1400 - protein, 11 aa, Homo sapiens
ASSYGSNQPQH

SEQ ID NO: 1401 - protein, 10 aa, Homo sapiens
ASSLPSYEQY

SEQ ID NO: 1402 - protein, 10 aa, Homo sapiens
ASSLASDTQY

SEQ ID NO: 1403 - protein, 11 aa, Homo sapiens
ASSPRVNTEAF

SEQ ID NO: 1404 - protein, 12 aa, Homo sapiens
ASSLGAGNTEAF

SEQ ID NO: 1405 - protein, 11 aa, Homo sapiens
ASSQGGGTEAF

SEQ ID NO: 1406 - protein, 11 aa, Homo sapiens
ASSLAQNTEAF

SEQ ID NO: 1407 - protein, 10 aa, Homo sapiens
ASSSRGYEQY

SEQ ID NO: 1408 - protein, 9 aa, Homo sapiens
ASRQNTEAF

SEQ ID NO: 1409 - protein, 11 aa, Homo sapiens
ASSLGGDYGYT

SEQ ID NO: 1410 - protein, 11 aa, Homo sapiens
ASSWDSNQPQH

SEQ ID NO: 1411 - protein, 9 aa, Homo sapiens
ASSENTEAF

SEQ ID NO: 1412 - protein, 11 aa, Homo sapiens
ASSPRQNTEAF

SEQ ID NO: 1413 - protein, 9 aa, Homo sapiens
ASSPGNTIY

SEQ ID NO: 1414 - protein, 10 aa, Homo sapiens
ASSPQNTEAF

SEQ ID NO: 1415 - protein, 8 aa, Homo sapiens
ASSEETQY

SEQ ID NO: 1416 - protein, 10 aa, Homo sapiens
ASSRGQETQY

SEQ ID NO: 1417 - protein, 11 aa, Homo sapiens
ASSLQRNTEAF

SEQ ID NO: 1418 - protein, 12 aa, Homo sapiens
ASSLDSSTDTQY

SEQ ID NO: 1419 - protein, 9 aa, Homo sapiens
ASSPSNEQF

SEQ ID NO: 1420 - protein, 10 aa, Homo sapiens
ASSSVNTEAF

SEQ ID NO: 1421 - protein, 10 aa, Homo sapiens
ASSSPTDTQY

SEQ ID NO: 1422 - protein, 10 aa, Homo sapiens
ASSPSGDTQY

SEQ ID NO: 1423 - protein, 9 aa, Homo sapiens
ASSSNNEQF

SEQ ID NO: 1424 - protein, 10 aa, Homo sapiens
ASSFSNTEAF

SEQ ID NO: 1425 - protein, 9 aa, Homo sapiens
ASSSKETQY

SEQ ID NO: 1426 - protein, 12 aa, Homo sapiens
ASSPRQGSYEQY

SEQ ID NO: 1427 - protein, 12 aa, Homo sapiens
ASSPGQGNSPLH

SEQ ID NO: 1428 - protein, 11 aa, Homo sapiens
ASSPRENTEAF

SEQ ID NO: 1429 - protein, 12 aa, Homo sapiens
ASSLASSYNEQF

SEQ ID NO: 1430 - protein, 12 aa, Homo sapiens
ASSLTSGYNEQF

SEQ ID NO: 1431 - protein, 11 aa, Homo sapiens
ASSFSSYNEQF

SEQ ID NO: 1432 - protein, 11 aa, Homo sapiens
ASSSGRNTEAF

SEQ ID NO: 1433 - protein, 11 aa, Homo sapiens
ASSLTGSTEAF

SEQ ID NO: 1434 - protein, 12 aa, Homo sapiens
ASSRDSSYNEQF

SEQ ID NO: 1435 - protein, 9 aa, Homo sapiens
ASSAGYEQY

SEQ ID NO: 1436 - protein, 11 aa, Homo sapiens
ASSPGTNTEAF

SEQ ID NO: 1437 - protein, 9 aa, Homo sapiens
ASSLGNEQY

SEQ ID NO: 1438 - protein, 13 aa, Homo sapiens
ASSLDGSSYNEQF

SEQ ID NO: 1439 - protein, 12 aa, Homo sapiens
ASSLDRGQETQY

SEQ ID NO: 1440 - protein, 13 aa, Homo sapiens
ASSPLAGGTDTQY

SEQ ID NO: 1441 - protein, 10 aa, Homo sapiens
ASSSQGNEQF

SEQ ID NO: 1442 - protein, 11 aa, Homo sapiens
ASSLLNTGELF

SEQ ID NO: 1443 - protein, 12 aa, Homo sapiens
ASSLTSGQETQY

SEQ ID NO: 1444 - protein, 13 aa, Homo sapiens
ASSLAGGGTDTQY

SEQ ID NO: 1445 - protein, 11 aa, Homo sapiens
ASSFSSTDTQY

SEQ ID NO: 1446 - protein, 11 aa, Homo sapiens
ASSPGTEETQY

SEQ ID NO: 1447 - protein, 9 aa, Homo sapiens
ASSLTNEQF

SEQ ID NO: 1448 - protein, 10 aa, Homo sapiens
ASSSLNQPQH

SEQ ID NO: 1449 - protein, 13 aa, Homo sapiens
ASSPGTSSYNEQF

SEQ ID NO: 1450 - protein, 10 aa, Homo sapiens
ASSLDRDTQY

SEQ ID NO: 1451 - protein, 11 aa, Homo sapiens
ASSPRGDTEAF

SEQ ID NO: 1452 - protein, 11 aa, Homo sapiens
ASSFRGNQPQH

SEQ ID NO: 1453 - protein, 10 aa, Homo sapiens
ASSFSGYEQY

SEQ ID NO: 1454 - protein, 11 aa, Homo sapiens
ASSLNSYNEQF

SEQ ID NO: 1455 - protein, 12 aa, Homo sapiens
ASSRDRGNQPQH

SEQ ID NO: 1456 - protein, 9 aa, Homo sapiens
ASSLAGEQF

SEQ ID NO: 1457 - protein, 11 aa, Homo sapiens
ASSRTGGYEQY

SEQ ID NO: 1458 - protein, 11 aa, Homo sapiens
ASSPTLNTEAF

SEQ ID NO: 1459 - protein, 11 aa, Homo sapiens
ASSADRNTEAF

SEQ ID NO: 1460 - protein, 12 aa, Homo sapiens
ASSLDGSNQPQH

SEQ ID NO: 1461 - protein, 10 aa, Homo sapiens
ASSPTGDTQY

SEQ ID NO: 1462 - protein, 11 aa, Homo sapiens
ASSFGPNTEAF

SEQ ID NO: 1463 - protein, 8 aa, Homo sapiens
ASGSYEQY

SEQ ID NO: 1464 - protein, 10 aa, Homo sapiens
ASSPSGETQY

SEQ ID NO: 1465 - protein, 12 aa, Homo sapiens
ASSLGGPNTEAF

SEQ ID NO: 1466 - protein, 9 aa, Homo sapiens
ASSQDYEQY

SEQ ID NO: 1467 - protein, 9 aa, Homo sapiens
ASSSLETQY

SEQ ID NO: 1468 - protein, 11 aa, Homo sapiens
ASSQDGNQPQH

SEQ ID NO: 1469 - protein, 11 aa, Homo sapiens
ASSLESTDTQY

SEQ ID NO: 1470 - protein, 12 aa, Homo sapiens
ASSLGTLNTEAF

SEQ ID NO: 1471 - protein, 11 aa, Homo sapiens
ASSLANTGELF

SEQ ID NO: 1472 - protein, 11 aa, Homo sapiens
ASSLGKNTEAF

SEQ ID NO: 1473 - protein, 10 aa, Homo sapiens
ASSQDTDTQY

SEQ ID NO: 1474 - protein, 11 aa, Homo sapiens
ASSPDSQETQY

SEQ ID NO: 1475 - protein, 10 aa, Homo sapiens
ASSLRTGELF

SEQ ID NO: 1476 - protein, 10 aa, Homo sapiens
ASSVGTDTQY

SEQ ID NO: 1477 - protein, 9 aa, Homo sapiens
ASSRTGELF

SEQ ID NO: 1478 - protein, 11 aa, Homo sapiens
ASSSGPNTEAF

SEQ ID NO: 1479 - protein, 12 aa, Homo sapiens
ASSLDRANTEAF

SEQ ID NO: 1480 - protein, 9 aa, Homo sapiens
ASSQRETQY

SEQ ID NO: 1481 - protein, 9 aa, Homo sapiens
ASSLGREQY

SEQ ID NO: 1482 - protein, 12 aa, Homo sapiens
ASSPGTGGTEAF

SEQ ID NO: 1483 - protein, 11 aa, Homo sapiens
ASSRDGNQPQH

SEQ ID NO: 1484 - protein, 12 aa, Homo sapiens
ASSPGGSGNTIY

SEQ ID NO: 1485 - protein, 12 aa, Homo sapiens
ASSYSGSTDTQY

SEQ ID NO: 1486 - protein, 12 aa, Homo sapiens
ASSYGTSTDTQY

SEQ ID NO: 1487 - protein, 11 aa, Homo sapiens
ASSYSGGTEAF

SEQ ID NO: 1488 - protein, 11 aa, Homo sapiens
ASSPSLNTEAF

SEQ ID NO: 1489 - protein, 10 aa, Homo sapiens
ASSLGGDEQF

SEQ ID NO: 1490 - protein, 11 aa, Homo sapiens
ASSLGTNYGYT

SEQ ID NO: 1491 - protein, 11 aa, Homo sapiens
ASRGTGNQPQH

SEQ ID NO: 1492 - protein, 12 aa, Homo sapiens
ASSLTGSYNEQF

SEQ ID NO: 1493 - protein, 10 aa, Homo sapiens
ASSLGGGEQY

SEQ ID NO: 1494 - protein, 11 aa, Homo sapiens
ASSLTMNTEAF

SEQ ID NO: 1495 - protein, 11 aa, Homo sapiens
ASSPGTQETQY

SEQ ID NO: 1496 - protein, 12 aa, Homo sapiens
ASSLAGNTGELF

SEQ ID NO: 1497 - protein, 12 aa, Homo sapiens
ASSRTSGYNEQF

SEQ ID NO: 1498 - protein, 11 aa, Homo sapiens
ASSLSGDTEAF

SEQ ID NO: 1499 - protein, 12 aa, Homo sapiens
ASSFSGSSYEQY

SEQ ID NO: 1500 - protein, 10 aa, Homo sapiens
ASSLRSYEQY

SEQ ID NO: 1501 - protein, 12 aa, Homo sapiens
ASSSGGSYNEQF

SEQ ID NO: 1502 - protein, 10 aa, Homo sapiens
ASSPTYNEQF

SEQ ID NO: 1503 - protein, 11 aa, Homo sapiens
ASSFRENTEAF

SEQ ID NO: 1504 - protein, 12 aa, Homo sapiens
ASSRQGMNTEAF

SEQ ID NO: 1505 - protein, 12 aa, Homo sapiens
ASSLSSSYNEQF

SEQ ID NO: 1506 - protein, 10 aa, Homo sapiens
ASSLGSQPQH

SEQ ID NO: 1507 - protein, 10 aa, Homo sapiens
ASSLGAGELF

SEQ ID NO: 1508 - protein, 9 aa, Homo sapiens
ASSTGYEQY

SEQ ID NO: 1509 - protein, 11 aa, Homo sapiens
ASSPDRGTEAF

SEQ ID NO: 1510 - protein, 11 aa, Homo sapiens
ASSLRGDQPQH

SEQ ID NO: 1511 - protein, 12 aa, Homo sapiens
ASSLDRGGTEAF

SEQ ID NO: 1512 - protein, 11 aa, Homo sapiens
ASSLGSNYGYT

SEQ ID NO: 1513 - protein, 12 aa, Homo sapiens
ASSLLGGNTEAF

SEQ ID NO: 1514 - protein, 10 aa, Homo sapiens
ASSLGSNEQF

SEQ ID NO: 1515 - protein, 12 aa, Homo sapiens
ASSLGVSTDTQY

SEQ ID NO: 1516 - protein, 12 aa, Homo sapiens
ASSQDRGNTEAF

SEQ ID NO: 1517 - protein, 10 aa, Homo sapiens
ASSFGTGELF

SEQ ID NO: 1518 - protein, 10 aa, Homo sapiens
ASSPHTDTQY

SEQ ID NO: 1519 - protein, 9 aa, Homo sapiens
ASSFTYEQY

SEQ ID NO: 1520 - protein, 11 aa, Homo sapiens
ASSVDSNQPQH

SEQ ID NO: 1521 - protein, 12 aa, Homo sapiens
ASSPQGLNTEAF

SEQ ID NO: 1522 - protein, 10 aa, Homo sapiens
ASSLSSDTQY

SEQ ID NO: 1523 - protein, 10 aa, Homo sapiens
ASSGSNQPQH

SEQ ID NO: 1524 - protein, 11 aa, Homo sapiens
ASSLSRGTEAF

SEQ ID NO: 1525 - protein, 11 aa, Homo sapiens
ASRRDSNQPQH

SEQ ID NO: 1526 - protein, 11 aa, Homo sapiens
ASSLTNTGELF

SEQ ID NO: 1527 - protein, 9 aa, Homo sapiens
ASSLGHEQY

SEQ ID NO: 1528 - protein, 11 aa, Homo sapiens
ASSPSGSYEQY

SEQ ID NO: 1529 - protein, 13 aa, Homo sapiens
ASSLGGYSNQPQH

SEQ ID NO: 1530 - protein, 9 aa, Homo sapiens
ASSLGGELF

SEQ ID NO: 1531 - protein, 11 aa, Homo sapiens
ASSPDLNTEAF

SEQ ID NO: 1532 - protein, 12 aa, Homo sapiens
ASSDSSGANVLT

SEQ ID NO: 1533 - protein, 10 aa, Homo sapiens
ASSLNYNEQF

SEQ ID NO: 1534 - protein, 10 aa, Homo sapiens
ASRQGNTEAF

SEQ ID NO: 1535 - protein, 11 aa, Homo sapiens
ASSSTGNQPQH

SEQ ID NO: 1536 - protein, 11 aa, Homo sapiens
ASSLVGADTQY

SEQ ID NO: 1537 - protein, 12 aa, Homo sapiens
ASSLGRGNQPQH

SEQ ID NO: 1538 - protein, 12 aa, Homo sapiens
ASSLGTAQETQY

SEQ ID NO: 1539 - protein, 12 aa, Homo sapiens
ASSLEGLNTEAF

SEQ ID NO: 1540 - protein, 13 aa, Homo sapiens
ASSRLAGGTDTQY

SEQ ID NO: 1541 - protein, 11 aa, Homo sapiens
ASSFSVNTEAF

SEQ ID NO: 1542 - protein, 11 aa, Homo sapiens
ASSLGLANEQF

SEQ ID NO: 1543 - protein, 10 aa, Homo sapiens
ASSLDTYEQY

SEQ ID NO: 1544 - protein, 12 aa, Homo sapiens
ASSPSGSYNEQF

SEQ ID NO: 1545 - protein, 13 aa, Homo sapiens
ASSPGTGGNQPQH

SEQ ID NO: 1546 - protein, 11 aa, Homo sapiens
ASSSDSYNEQF

SEQ ID NO: 1547 - protein, 9 aa, Homo sapiens
ASSYSNEQF

SEQ ID NO: 1548 - protein, 13 aa, Homo sapiens
ASSPGTSGTDTQY

SEQ ID NO: 1549 - protein, 11 aa, Homo sapiens
ASSSTENTEAF

SEQ ID NO: 1550 - protein, 9 aa, Homo sapiens
ASSVGDTQY

SEQ ID NO: 1551 - protein, 9 aa, Homo sapiens
ASSPDNEQF

SEQ ID NO: 1552 - protein, 11 aa, Homo sapiens
ASSPSGNTEAF

SEQ ID NO: 1553 - protein, 11 aa, Homo sapiens
ASSRTGDTEAF

SEQ ID NO: 1554 - protein, 11 aa, Homo sapiens
ASSLRGTGELF

SEQ ID NO: 1555 - protein, 11 aa, Homo sapiens
ASSLQGYNEQF

SEQ ID NO: 1556 - protein, 12 aa, Homo sapiens
ASSFGQGNTEAF

SEQ ID NO: 1557 - protein, 12 aa, Homo sapiens
ASSLGTSGYEQY

SEQ ID NO: 1558 - protein, 13 aa, Homo sapiens
ASSLRGSSYNEQF

SEQ ID NO: 1559 - protein, 11 aa, Homo sapiens
ASSLSRTDTQY

SEQ ID NO: 1560 - protein, 12 aa, Homo sapiens
ASSLGSSNQPQH

SEQ ID NO: 1561 - protein, 9 aa, Homo sapiens
ASSNTGELF

SEQ ID NO: 1562 - protein, 10 aa, Homo sapiens
ASSEQGYEQY

SEQ ID NO: 1563 - protein, 10 aa, Homo sapiens
ASSLSRDTQY

SEQ ID NO: 1564 - protein, 11 aa, Homo sapiens
ASSFSGNQPQH

SEQ ID NO: 1565 - protein, 9 aa, Homo sapiens
ASRSYNEQF

SEQ ID NO: 1566 - protein, 14 aa, Homo sapiens
ASSLGLAGSTDTQY

SEQ ID NO: 1567 - protein, 11 aa, Homo sapiens
ASSPGGYNEQF

SEQ ID NO: 1568 - protein, 11 aa, Homo sapiens
ASSLGGSYGYT

SEQ ID NO: 1569 - protein, 11 aa, Homo sapiens
ASSPGQYNEQF

SEQ ID NO: 1570 - protein, 11 aa, Homo sapiens
ASSLRANTEAF

SEQ ID NO: 1571 - protein, 10 aa, Homo sapiens
ASSQDQETQY

SEQ ID NO: 1572 - protein, 11 aa, Homo sapiens
ASSRSSYNEQF

SEQ ID NO: 1573 - protein, 10 aa, Homo sapiens
ASSLPGYEQY

SEQ ID NO: 1574 - protein, 11 aa, Homo sapiens
ASSLRGNYGYT

SEQ ID NO: 1575 - protein, 9 aa, Homo sapiens
ASSFLYEQY

SEQ ID NO: 1576 - protein, 10 aa, Homo sapiens
ASSFLNQPQH

SEQ ID NO: 1577 - protein, 12 aa, Homo sapiens
ASSPGQGQETQY

SEQ ID NO: 1578 - protein, 11 aa, Homo sapiens
ASSPRLNTEAF

SEQ ID NO: 1579 - protein, 11 aa, Homo sapiens
ASSDRGNQPQH

SEQ ID NO: 1580 - protein, 12 aa, Homo sapiens
ASSFGQGNQPQH

SEQ ID NO: 1581 - protein, 11 aa, Homo sapiens
ASSLGAQETQY

SEQ ID NO: 1582 - protein, 11 aa, Homo sapiens
ASSLDGYNEQF

SEQ ID NO: 1583 - protein, 12 aa, Homo sapiens
ASSLAGTYNEQF

SEQ ID NO: 1584 - protein, 11 aa, Homo sapiens
ASSLPGSYEQY

SEQ ID NO: 1585 - protein, 12 aa, Homo sapiens
ASSPQGGNQPQH

SEQ ID NO: 1586 - protein, 10 aa, Homo sapiens
ASSPPGDTQY

SEQ ID NO: 1587 - protein, 12 aa, Homo sapiens
ASSLGQGDQPQH

SEQ ID NO: 1588 - protein, 12 aa, Homo sapiens
ASSLSGGQETQY

SEQ ID NO: 1589 - protein, 11 aa, Homo sapiens
ASSLSRDTEAF

SEQ ID NO: 1590 - protein, 11 aa, Homo sapiens
ASSPDGNTEAF

SEQ ID NO: 1591 - protein, 12 aa, Homo sapiens
ASSLAGPTDTQY

SEQ ID NO: 1592 - protein, 10 aa, Homo sapiens
ASSFGGETQY

SEQ ID NO: 1593 - protein, 11 aa, Homo sapiens
ASSPGQGETQY

SEQ ID NO: 1594 - protein, 11 aa, Homo sapiens
ASSFQGTDTQY

SEQ ID NO: 1595 - protein, 11 aa, Homo sapiens
ASSLQANTEAF

SEQ ID NO: 1596 - protein, 13 aa, Homo sapiens
ASSLGQSSYNEQF

SEQ ID NO: 1597 - protein, 11 aa, Homo sapiens
ASSQGLQETQY

SEQ ID NO: 1598 - protein, 10 aa, Homo sapiens
SARQGDTEAF

SEQ ID NO: 1599 - protein, 12 aa, Homo sapiens
ASSPGTGTDTQY

SEQ ID NO: 1600 - protein, 9 aa, Homo sapiens
ASSLINEQF

SEQ ID NO: 1601 - protein, 12 aa, Homo sapiens
ASSLGGAYNEQF

SEQ ID NO: 1602 - protein, 8 aa, Homo sapiens
ASSLYEQY

SEQ ID NO: 1603 - protein, 10 aa, Homo sapiens
ASSSGGETQY

SEQ ID NO: 1604 - protein, 12 aa, Homo sapiens
ASSLAGPYNEQF

SEQ ID NO: 1605 - protein, 9 aa, Homo sapiens
ASSRDNEQF

SEQ ID NO: 1606 - protein, 12 aa, Homo sapiens
ASSLAGANTEAF

SEQ ID NO: 1607 - protein, 12 aa, Homo sapiens
ASSPTGGTDTQY

SEQ ID NO: 1608 - protein, 12 aa, Homo sapiens
ASSLTSSYNEQF

SEQ ID NO: 1609 - protein, 12 aa, Homo sapiens
ASSLGNSNQPQH

SEQ ID NO: 1610 - protein, 12 aa, Homo sapiens
ASSPSGSSYEQY

SEQ ID NO: 1611 - protein, 9 aa, Homo sapiens
ASSSHYEQY

SEQ ID NO: 1612 - protein, 10 aa, Homo sapiens
ASSYSRETQY

SEQ ID NO: 1613 - protein, 10 aa, Homo sapiens
ASSASSYEQY

SEQ ID NO: 1614 - protein, 12 aa, Homo sapiens
ASSPGQGGYEQY

SEQ ID NO: 1615 - protein, 12 aa, Homo sapiens
ASSLDRMNTEAF

SEQ ID NO: 1616 - protein, 11 aa, Homo sapiens
ASSLEGSYEQY

SEQ ID NO: 1617 - protein, 9 aa, Homo sapiens
ASRMNTEAF

SEQ ID NO: 1618 - protein, 11 aa, Homo sapiens
ASSQDSYNEQF

SEQ ID NO: 1619 - protein, 10 aa, Homo sapiens
ASSQGGQPQH

SEQ ID NO: 1620 - protein, 11 aa, Homo sapiens
ASSLDVNTEAF

SEQ ID NO: 1621 - protein, 9 aa, Homo sapiens
ASSLHNEQF

SEQ ID NO: 1622 - protein, 11 aa, Homo sapiens
ASSPTGDTEAF

SEQ ID NO: 1623 - protein, 11 aa, Homo sapiens
ASSRGSYNEQF

SEQ ID NO: 1624 - protein, 10 aa, Homo sapiens
ASSPDQETQY

SEQ ID NO: 1625 - protein, 12 aa, Homo sapiens
ASSPGTGQETQY

SEQ ID NO: 1626 - protein, 12 aa, Homo sapiens
ASSLAGGPNEQF

SEQ ID NO: 1627 - protein, 12 aa, Homo sapiens
ASSPDRGNTEAF

SEQ ID NO: 1628 - protein, 13 aa, Homo sapiens
ASSLVGSSYNEQF

SEQ ID NO: 1629 - protein, 11 aa, Homo sapiens
ASSGTANTEAF

SEQ ID NO: 1630 - protein, 11 aa, Homo sapiens
ASSSGVNTEAF

SEQ ID NO: 1631 - protein, 10 aa, Homo sapiens
ASSPPGQPQH

SEQ ID NO: 1632 - protein, 11 aa, Homo sapiens
ASSSTGNYGYT

SEQ ID NO: 1633 - protein, 12 aa, Homo sapiens
ASSQGGSNQPQH

SEQ ID NO: 1634 - protein, 11 aa, Homo sapiens
ASSLNLNTEAF

SEQ ID NO: 1635 - protein, 12 aa, Homo sapiens
ASSPDRGTDTQY

SEQ ID NO: 1636 - protein, 12 aa, Homo sapiens
ASSSGQGSYEQY

SEQ ID NO: 1637 - protein, 11 aa, Homo sapiens
ASSPGGNYGYT

SEQ ID NO: 1638 - protein, 11 aa, Homo sapiens
ASSLGQPYEQY

SEQ ID NO: 1639 - protein, 11 aa, Homo sapiens
ASSLVSSYEQY

SEQ ID NO: 1640 - protein, 11 aa, Homo sapiens
ASSPQVNTEAF

SEQ ID NO: 1641 - protein, 10 aa, Homo sapiens
ASSPMNTEAF

SEQ ID NO: 1642 - protein, 10 aa, Homo sapiens
ASSLSNYGYT

SEQ ID NO: 1643 - protein, 10 aa, Homo sapiens
ASSSGGYGYT

SEQ ID NO: 1644 - protein, 12 aa, Homo sapiens
ASSPRTGSYEQY

SEQ ID NO: 1645 - protein, 12 aa, Homo sapiens
ASSLGTVQETQY

SEQ ID NO: 1646 - protein, 12 aa, Homo sapiens
ASSPGLAGYEQY

SEQ ID NO: 1647 - protein, 12 aa, Homo sapiens
ASSLAGVTDTQY

SEQ ID NO: 1648 - protein, 9 aa, Homo sapiens
ASSYSDTQY

SEQ ID NO: 1649 - protein, 9 aa, Homo sapiens
ASSYSETQY

SEQ ID NO: 1650 - protein, 11 aa, Homo sapiens
ASSLVANTEAF

SEQ ID NO: 1651 - protein, 10 aa, Homo sapiens
ASSFGADTQY

SEQ ID NO: 1652 - protein, 12 aa, Homo sapiens
ASSLQGVNTEAF

SEQ ID NO: 1653 - protein, 12 aa, Homo sapiens
ASSLLGSNQPQH

SEQ ID NO: 1654 - protein, 11 aa, Homo sapiens
ASSLTGYTEAF

SEQ ID NO: 1655 - protein, 11 aa, Homo sapiens
ASSLEENTEAF

SEQ ID NO: 1656 - protein, 11 aa, Homo sapiens
ASSLAGGQPQH

SEQ ID NO: 1657 - protein, 12 aa, Homo sapiens
ASSRGGSTDTQY

SEQ ID NO: 1658 - protein, 12 aa, Homo sapiens
ASSLTDSNQPQH

SEQ ID NO: 1659 - protein, 12 aa, Homo sapiens
ASSSGTGTYEQY

SEQ ID NO: 1660 - protein, 13 aa, Homo sapiens
ASSLGQGAYNEQF

SEQ ID NO: 1661 - protein, 12 aa, Homo sapiens
ASSLTGNTGELF

SEQ ID NO: 1662 - protein, 12 aa, Homo sapiens
ASSPTSGSYEQY

SEQ ID NO: 1663 - protein, 12 aa, Homo sapiens
ASSLAGRNTEAF

SEQ ID NO: 1664 - protein, 11 aa, Homo sapiens
ASSPRGSYEQY

SEQ ID NO: 1665 - protein, 10 aa, Homo sapiens
ASSLGVNEQF

SEQ ID NO: 1666 - protein, 9 aa, Homo sapiens
ASSETDTQY

SEQ ID NO: 1667 - protein, 11 aa, Homo sapiens
ASSFQGNQPQH

SEQ ID NO: 1668 - protein, 11 aa, Homo sapiens
ASSSGQTYEQY

SEQ ID NO: 1669 - protein, 12 aa, Homo sapiens
ASSFGQGAYEQY

SEQ ID NO: 1670 - protein, 9 aa, Homo sapiens
ASSWGYEQY

SEQ ID NO: 1671 - protein, 11 aa, Homo sapiens
ASSSQGTDTQY

SEQ ID NO: 1672 - protein, 10 aa, Homo sapiens
ASSSPSYEQY

SEQ ID NO: 1673 - protein, 11 aa, Homo sapiens
ASSPDGNQPQH

SEQ ID NO: 1674 - protein, 11 aa, Homo sapiens
ASSLQGGQPQH

SEQ ID NO: 1675 - protein, 11 aa, Homo sapiens
ASSSGLQETQY

SEQ ID NO: 1676 - protein, 11 aa, Homo sapiens
ASSLSGADTQY

SEQ ID NO: 1677 - protein, 11 aa, Homo sapiens
ASSLGQSYGYT

SEQ ID NO: 1678 - protein, 10 aa, Homo sapiens
SARDSNQPQH

SEQ ID NO: 1679 - protein, 10 aa, Homo sapiens
ASSLANYGYT

SEQ ID NO: 1680 - protein, 10 aa, Homo sapiens
ASRTSTDTQY

SEQ ID NO: 1681 - protein, 10 aa, Homo sapiens
ASSFPNTEAF

SEQ ID NO: 1682 - protein, 9 aa, Homo sapiens
ASSPRYEQY

SEQ ID NO: 1683 - protein, 10 aa, Homo sapiens
ASSRYQETQY

SEQ ID NO: 1684 - protein, 10 aa, Homo sapiens
ASSSTYNEQF

SEQ ID NO: 1685 - protein, 10 aa, Homo sapiens
ASSPGNYGYT

SEQ ID NO: 1686 - protein, 10 aa, Homo sapiens
ASSLESYEQY

SEQ ID NO: 1687 - protein, 10 aa, Homo sapiens
ASSLAEETQY

SEQ ID NO: 1688 - protein, 11 aa, Homo sapiens
ASRTSGTDTQY

SEQ ID NO: 1689 - protein, 10 aa, Homo sapiens
ASSQQGYEQY

SEQ ID NO: 1690 - protein, 11 aa, Homo sapiens
ASSYDSNQPQH

SEQ ID NO: 1691 - protein, 11 aa, Homo sapiens
ASSFTSTDTQY

SEQ ID NO: 1692 - protein, 10 aa, Homo sapiens
ASRTGNQPQH

SEQ ID NO: 1693 - protein, 9 aa, Homo sapiens
ASSSPDTQY

SEQ ID NO: 1694 - protein, 11 aa, Homo sapiens
ASSYGSSYEQY

SEQ ID NO: 1695 - protein, 11 aa, Homo sapiens
ASSLNSGNTIY

SEQ ID NO: 1696 - protein, 10 aa, Homo sapiens
ASSFGDTEAF

SEQ ID NO: 1697 - protein, 9 aa, Homo sapiens
ASGSTDTQY

SEQ ID NO: 1698 - protein, 12 aa, Homo sapiens
ASSRTGSTDTQY

SEQ ID NO: 1699 - protein, 11 aa, Homo sapiens
ASSYRVNTEAF

SEQ ID NO: 1700 - protein, 12 aa, Homo sapiens
ASSLGGGGTEAF

SEQ ID NO: 1701 - protein, 11 aa, Homo sapiens
ASSFSLNTEAF

SEQ ID NO: 1702 - protein, 10 aa, Homo sapiens
ASSLDADTQY

SEQ ID NO: 1703 - protein, 12 aa, Homo sapiens
ASSLGRSSYEQY

SEQ ID NO: 1704 - protein, 11 aa, Homo sapiens
ASSLGYTDTQY

SEQ ID NO: 1705 - protein, 11 aa, Homo sapiens
ASSLGPTYEQY

SEQ ID NO: 1706 - protein, 11 aa, Homo sapiens
ASSLGTTYEQY

SEQ ID NO: 1707 - protein, 11 aa, Homo sapiens
ASSRTGQETQY

SEQ ID NO: 1708 - protein, 11 aa, Homo sapiens
ASSLAGTGELF

SEQ ID NO: 1709 - protein, 12 aa, Homo sapiens
ASSQGQGNQPQH

SEQ ID NO: 1710 - protein, 11 aa, Homo sapiens
ASSLVGDTEAF

SEQ ID NO: 1711 - protein, 12 aa, Homo sapiens
ASSRGQGNTEAF

SEQ ID NO: 1712 - protein, 12 aa, Homo sapiens
ASSRTGSSYEQY

SEQ ID NO: 1713 - protein, 11 aa, Homo sapiens
ASSLRDSYEQY

SEQ ID NO: 1714 - protein, 11 aa, Homo sapiens
ASSFNSNQPQH

SEQ ID NO: 1715 - protein, 11 aa, Homo sapiens
ASSSGMNTEAF

SEQ ID NO: 1716 - protein, 9 aa, Homo sapiens
ASSFDTEAF

SEQ ID NO: 1717 - protein, 11 aa, Homo sapiens
ASSLDRTYEQY

SEQ ID NO: 1718 - protein, 10 aa, Homo sapiens
SARTGNTEAF

SEQ ID NO: 1719 - protein, 9 aa, Homo sapiens
ASSLFYEQY

SEQ ID NO: 1720 - protein, 10 aa, Homo sapiens
ASSQNTDTQY

SEQ ID NO: 1721 - protein, 12 aa, Homo sapiens
ASSRDRGNTEAF

SEQ ID NO: 1722 - protein, 9 aa, Homo sapiens
ASSFGNTIY

SEQ ID NO: 1723 - protein, 12 aa, Homo sapiens
ASSPDRVNTEAF

SEQ ID NO: 1724 - protein, 11 aa, Homo sapiens
ASSQDRDTEAF

SEQ ID NO: 1725 - protein, 10 aa, Homo sapiens
ASSPQGETQY

SEQ ID NO: 1726 - protein, 12 aa, Homo sapiens
ASSGQGGNQPQH

SEQ ID NO: 1727 - protein, 12 aa, Homo sapiens
ASSFGGSGNTIY

SEQ ID NO: 1728 - protein, 10 aa, Homo sapiens
ASSFQGYEQY

SEQ ID NO: 1729 - protein, 10 aa, Homo sapiens
ASSLRQETQY

SEQ ID NO: 1730 - protein, 13 aa, Homo sapiens
ASSLLAGSTDTQY

SEQ ID NO: 1731 - protein, 12 aa, Homo sapiens
ASSFGSSYNEQF

SEQ ID NO: 1732 - protein, 9 aa, Homo sapiens
ASRGGTEAF

SEQ ID NO: 1733 - protein, 11 aa, Homo sapiens
ASSFTGGTEAF

SEQ ID NO: 1734 - protein, 12 aa, Homo sapiens
ASSLAGGGTEAF

SEQ ID NO: 1735 - protein, 9 aa, Homo sapiens
ASSLFNEQF

SEQ ID NO: 1736 - protein, 9 aa, Homo sapiens
ASSSTGELF

SEQ ID NO: 1737 - protein, 9 aa, Homo sapiens
ASSFRNEQF

SEQ ID NO: 1738 - protein, 10 aa, Homo sapiens
ASSFGDQPQH

SEQ ID NO: 1739 - protein, 12 aa, Homo sapiens
ASSRGSSYNEQF

SEQ ID NO: 1740 - protein, 10 aa, Homo sapiens
ASSLEYNEQF

SEQ ID NO: 1741 - protein, 11 aa, Homo sapiens
ASSVGQNTEAF

SEQ ID NO: 1742 - protein, 11 aa, Homo sapiens
ASSRDRDYEQY

SEQ ID NO: 1743 - protein, 13 aa, Homo sapiens
ASSLTSGGYNEQF

SEQ ID NO: 1744 - protein, 12 aa, Homo sapiens
ASSLTGGGTEAF

SEQ ID NO: 1745 - protein, 10 aa, Homo sapiens
ASSLDNYGYT

SEQ ID NO: 1746 - protein, 12 aa, Homo sapiens
ASSPGRSTDTQY

SEQ ID NO: 1747 - protein, 13 aa, Homo sapiens
ASSPGQGSYNEQF

SEQ ID NO: 1748 - protein, 11 aa, Homo sapiens
ASSPRGQETQY

SEQ ID NO: 1749 - protein, 10 aa, Homo sapiens
ASSPTQETQY

SEQ ID NO: 1750 - protein, 12 aa, Homo sapiens
ASSPGPSTDTQY

SEQ ID NO: 1751 - protein, 12 aa, Homo sapiens
ASSSGTGNQPQH

SEQ ID NO: 1752 - protein, 11 aa, Homo sapiens
ASSPSSGNTIY

SEQ ID NO: 1753 - protein, 11 aa, Homo sapiens
ASSLGPNYGYT

SEQ ID NO: 1754 - protein, 12 aa, Homo sapiens
ASSPGTLNTEAF

SEQ ID NO: 1755 - protein, 13 aa, Homo sapiens
ASSLGLAGADTQY

SEQ ID NO: 1756 - protein, 10 aa, Homo sapiens
ASSYGTDTQY

SEQ ID NO: 1757 - protein, 10 aa, Homo sapiens
ASSLGLNEQF

SEQ ID NO: 1758 - protein, 12 aa, Homo sapiens
ASSSTGGTDTQY

SEQ ID NO: 1759 - protein, 11 aa, Homo sapiens
ASSLVGYNEQF

SEQ ID NO: 1760 - protein, 11 aa, Homo sapiens
ASSFYSNQPQH

SEQ ID NO: 1761 - protein, 12 aa, Homo sapiens
ASSLGLAGETQY

SEQ ID NO: 1762 - protein, 9 aa, Homo sapiens
ASSQAETQY

SEQ ID NO: 1763 - protein, 11 aa, Homo sapiens
ASSYSSNQPQH

SEQ ID NO: 1764 - protein, 11 aa, Homo sapiens
ASSYDRNTEAF

SEQ ID NO: 1765 - protein, 9 aa, Homo sapiens
ASSLLGEQY

SEQ ID NO: 1766 - protein, 11 aa, Homo sapiens
ASSSGGSYEQY

SEQ ID NO: 1767 - protein, 9 aa, Homo sapiens
ASSKNTEAF

SEQ ID NO: 1768 - protein, 9 aa, Homo sapiens
ASRQGYEQY

SEQ ID NO: 1769 - protein, 11 aa, Homo sapiens
ASSLGGNNEQF

SEQ ID NO: 1770 - protein, 11 aa, Homo sapiens
ASSPPSYNEQF

SEQ ID NO: 1771 - protein, 11 aa, Homo sapiens
ASSFSGSYEQY

SEQ ID NO: 1772 - protein, 11 aa, Homo sapiens
ASSLVGGNEQF

SEQ ID NO: 1773 - protein, 10 aa, Homo sapiens
ASSFLTDTQY

SEQ ID NO: 1774 - protein, 9 aa, Homo sapiens
ASSWGTEAF

SEQ ID NO: 1775 - protein, 11 aa, Homo sapiens
ASSFGGNYGYT

SEQ ID NO: 1776 - protein, 11 aa, Homo sapiens
ASSGQGGTEAF

SEQ ID NO: 1777 - protein, 12 aa, Homo sapiens
ASSPQGMNTEAF

SEQ ID NO: 1778 - protein, 12 aa, Homo sapiens
ASSFGGLNTEAF

SEQ ID NO: 1779 - protein, 10 aa, Homo sapiens
ASSSLSYEQY

SEQ ID NO: 1780 - protein, 11 aa, Homo sapiens
ASSLLMNTEAF

SEQ ID NO: 1781 - protein, 11 aa, Homo sapiens
ASSLVPNTEAF

SEQ ID NO: 1782 - protein, 11 aa, Homo sapiens
ASSFAGNTEAF

SEQ ID NO: 1783 - protein, 12 aa, Homo sapiens
ASSFGQGTDTQY

SEQ ID NO: 1784 - protein, 11 aa, Homo sapiens
ASSLTGPYEQY

SEQ ID NO: 1785 - protein, 10 aa, Homo sapiens
ASSFYTDTQY

SEQ ID NO: 1786 - protein, 12 aa, Homo sapiens
ASSLRSSYNEQF

SEQ ID NO: 1787 - protein, 12 aa, Homo sapiens
ASSLVGGSYEQY

SEQ ID NO: 1788 - protein, 12 aa, Homo sapiens
ASSLGGPYNEQF

SEQ ID NO: 1789 - protein, 10 aa, Homo sapiens
ASSFNTDTQY

SEQ ID NO: 1790 - protein, 11 aa, Homo sapiens
ASSLGQGDGYT

SEQ ID NO: 1791 - protein, 11 aa, Homo sapiens
ASSSGTYNEQF

SEQ ID NO: 1792 - protein, 11 aa, Homo sapiens
ASSPTGGYGYT

SEQ ID NO: 1793 - protein, 9 aa, Homo sapiens
ASSLATEAF

SEQ ID NO: 1794 - protein, 10 aa, Homo sapiens
ASSPLGNEQF

SEQ ID NO: 1795 - protein, 11 aa, Homo sapiens
ASSTQGNTEAF

SEQ ID NO: 1796 - protein, 9 aa, Homo sapiens
ASSPDTEAF

SEQ ID NO: 1797 - protein, 11 aa, Homo sapiens
ASSLDSGNTIY

SEQ ID NO: 1798 - protein, 13 aa, Homo sapiens
ASSELAGGPDTQY

SEQ ID NO: 1799 - protein, 10 aa, Homo sapiens
ASSPLQETQY

SEQ ID NO: 1800 - protein, 11 aa, Homo sapiens
ASSLSGTGELF

SEQ ID NO: 1801 - protein, 11 aa, Homo sapiens
ASSYSGNQPQH

SEQ ID NO: 1802 - protein, 11 aa, Homo sapiens
ASSFGSYNEQF

SEQ ID NO: 1803 - protein, 11 aa, Homo sapiens
ASSGTSTDTQY

SEQ ID NO: 1804 - protein, 11 aa, Homo sapiens
ASSPPGQETQY

SEQ ID NO: 1805 - protein, 12 aa, Homo sapiens
ASSPGLAGETQY

SEQ ID NO: 1806 - protein, 12 aa, Homo sapiens
ASSLGGSNTEAF

SEQ ID NO: 1807 - protein, 9 aa, Homo sapiens
ASRLTDTQY

SEQ ID NO: 1808 - protein, 10 aa, Homo sapiens
ASRGGNQPQH

SEQ ID NO: 1809 - protein, 10 aa, Homo sapiens
ASSQGGDTQY

SEQ ID NO: 1810 - protein, 9 aa, Homo sapiens
ASSEGETQY

SEQ ID NO: 1811 - protein, 10 aa, Homo sapiens
ASSFGGDTQY

SEQ ID NO: 1812 - protein, 9 aa, Homo sapiens
ASSSIYEQY

SEQ ID NO: 1813 - protein, 11 aa, Homo sapiens
ASSPRDSYEQY

SEQ ID NO: 1814 - protein, 11 aa, Homo sapiens
ASSYSLNTEAF

SEQ ID NO: 1815 - protein, 11 aa, Homo sapiens
ASSFPGNTEAF

SEQ ID NO: 1816 - protein, 10 aa, Homo sapiens
ASSQVGYEQY

SEQ ID NO: 1817 - protein, 11 aa, Homo sapiens
ASSLTQNTEAF

SEQ ID NO: 1818 - protein, 9 aa, Homo sapiens
ASSLQDTQY

SEQ ID NO: 1819 - protein, 12 aa, Homo sapiens
ASSPGQGNEKLF

SEQ ID NO: 1820 - protein, 11 aa, Homo sapiens
ASSLGGANVLT

SEQ ID NO: 1821 - protein, 11 aa, Homo sapiens
ASSRQMNTEAF

SEQ ID NO: 1822 - protein, 10 aa, Homo sapiens
ASSLRDQPQH

SEQ ID NO: 1823 - protein, 12 aa, Homo sapiens
ASSLQGSYNEQF

SEQ ID NO: 1824 - protein, 13 aa, Homo sapiens
ASSPGGSSYNEQF

SEQ ID NO: 1825 - protein, 10 aa, Homo sapiens
ASSLWGTEAF

SEQ ID NO: 1826 - protein, 11 aa, Homo sapiens
ASSTGLNTEAF

SEQ ID NO: 1827 - protein, 11 aa, Homo sapiens
ASSPDRGYEQY

SEQ ID NO: 1828 - protein, 11 aa, Homo sapiens
ASSRQLNTEAF

SEQ ID NO: 1829 - protein, 13 aa, Homo sapiens
ASSFGGSSYNEQF

SEQ ID NO: 1830 - protein, 10 aa, Homo sapiens
ASSLGNNEQF

SEQ ID NO: 1831 - protein, 10 aa, Homo sapiens
ASSPGRETQY

SEQ ID NO: 1832 - protein, 10 aa, Homo sapiens
ASSSGGQPQH

SEQ ID NO: 1833 - protein, 9 aa, Homo sapiens
ASSLNEKLF

SEQ ID NO: 1834 - protein, 12 aa, Homo sapiens
ASSSGLSTDTQY

SEQ ID NO: 1835 - protein, 10 aa, Homo sapiens
ASSLPYNEQF

SEQ ID NO: 1836 - protein, 11 aa, Homo sapiens
ASSPQMNTEAF

SEQ ID NO: 1837 - protein, 12 aa, Homo sapiens
ASSPGRMNTEAF

SEQ ID NO: 1838 - protein, 11 aa, Homo sapiens
ASSRDRNYGYT

SEQ ID NO: 1839 - protein, 11 aa, Homo sapiens
ASSFRVNTEAF

SEQ ID NO: 1840 - protein, 11 aa, Homo sapiens
ASSLGRNNEQF

SEQ ID NO: 1841 - protein, 12 aa, Homo sapiens
ASSLGQSSYEQY

SEQ ID NO: 1842 - protein, 10 aa, Homo sapiens
ASSSMNTEAF

SEQ ID NO: 1843 - protein, 11 aa, Homo sapiens
ASSSSSTDTQY

SEQ ID NO: 1844 - protein, 11 aa, Homo sapiens
ASSRQGDTEAF

SEQ ID NO: 1845 - protein, 12 aa, Homo sapiens
ASSLASGTDTQY

SEQ ID NO: 1846 - protein, 11 aa, Homo sapiens
ASSLGQDYGYT

SEQ ID NO: 1847 - protein, 11 aa, Homo sapiens
ASSPTGQETQY

SEQ ID NO: 1848 - protein, 10 aa, Homo sapiens
ASSLQGDTQY

SEQ ID NO: 1849 - protein, 11 aa, Homo sapiens
ASSPGANTEAF

SEQ ID NO: 1850 - protein, 11 aa, Homo sapiens
ASSLGQGGGYT

SEQ ID NO: 1851 - protein, 12 aa, Homo sapiens
ASSLRGSSYEQY

SEQ ID NO: 1852 - protein, 9 aa, Homo sapiens
ASSFGQPQH

SEQ ID NO: 1853 - protein, 10 aa, Homo sapiens
ASSQDGYEQY

SEQ ID NO: 1854 - protein, 11 aa, Homo sapiens
ASSAQGNTEAF

SEQ ID NO: 1855 - protein, 11 aa, Homo sapiens
ASSLVGTGELF

SEQ ID NO: 1856 - protein, 10 aa, Homo sapiens
ASSLNNQPQH

SEQ ID NO: 1857 - protein, 9 aa, Homo sapiens
ASSSVYEQY

SEQ ID NO: 1858 - protein, 11 aa, Homo sapiens
ASSRTGTDTQY

SEQ ID NO: 1859 - protein, 9 aa, Homo sapiens
ASSYNTEAF

SEQ ID NO: 1860 - protein, 10 aa, Homo sapiens
ASSLGGGEQF

SEQ ID NO: 1861 - protein, 8 aa, Homo sapiens
ASSDYEQY

SEQ ID NO: 1862 - protein, 11 aa, Homo sapiens
ASSPRGNQPQH

SEQ ID NO: 1863 - protein, 11 aa, Homo sapiens
ASSPRMNTEAF

SEQ ID NO: 1864 - protein, 10 aa, Homo sapiens
ASSPLGTEAF

SEQ ID NO: 1865 - protein, 12 aa, Homo sapiens
ASSPRTGQETQY

SEQ ID NO: 1866 - protein, 10 aa, Homo sapiens
ASSPTGNEQF

SEQ ID NO: 1867 - protein, 9 aa, Homo sapiens
ASSPRNEQF

SEQ ID NO: 1868 - protein, 10 aa, Homo sapiens
ASSYSGDTQY

SEQ ID NO: 1869 - protein, 10 aa, Homo sapiens
ASSPQGDTQY

SEQ ID NO: 1870 - protein, 10 aa, Homo sapiens
ASSPATDTQY

SEQ ID NO: 1871 - protein, 13 aa, Homo sapiens
ASSLGTSSYNEQF

SEQ ID NO: 1872 - protein, 13 aa, Homo sapiens
ASSLGRSSYNEQF

SEQ ID NO: 1873 - protein, 11 aa, Homo sapiens
ASSFQGGTEAF

SEQ ID NO: 1874 - protein, 12 aa, Homo sapiens
ASSPGGSSYEQY

SEQ ID NO: 1875 - protein, 11 aa, Homo sapiens
ASSLAGGYGYT

SEQ ID NO: 1876 - protein, 11 aa, Homo sapiens
ASSLSRNQPQH

SEQ ID NO: 1877 - protein, 10 aa, Homo sapiens
SARGGNTEAF

SEQ ID NO: 1878 - protein, 11 aa, Homo sapiens
ASSFTENTEAF

SEQ ID NO: 1879 - protein, 11 aa, Homo sapiens
ASSFGANTEAF

SEQ ID NO: 1880 - protein, 9 aa, Homo sapiens
ASSYGTEAF

SEQ ID NO: 1881 - protein, 12 aa, Homo sapiens
ASSSGTGNTEAF

SEQ ID NO: 1882 - protein, 12 aa, Homo sapiens
ASSLGATNEKLF

SEQ ID NO: 1883 - protein, 11 aa, Homo sapiens
ASSLTGRTEAF

SEQ ID NO: 1884 - protein, 11 aa, Homo sapiens
ASSLNMNTEAF

SEQ ID NO: 1885 - protein, 10 aa, Homo sapiens
ASSDSSYEQY

SEQ ID NO: 1886 - protein, 12 aa, Homo sapiens
ASSRQGLNTEAF

SEQ ID NO: 1887 - protein, 10 aa, Homo sapiens
ASSFMNTEAF

SEQ ID NO: 1888 - protein, 10 aa, Homo sapiens
ASSQGGYGYT

SEQ ID NO: 1889 - protein, 13 aa, Homo sapiens
ASSLTGGSYNEQF

SEQ ID NO: 1890 - protein, 12 aa, Homo sapiens
ASSLGGTYNEQF

SEQ ID NO: 1891 - protein, 13 aa, Homo sapiens
ASSSLAGGYNEQF

SEQ ID NO: 1892 - protein, 12 aa, Homo sapiens
ASSLQGSSYEQY

SEQ ID NO: 1893 - protein, 11 aa, Homo sapiens
ASSLVSYNEQF

SEQ ID NO: 1894 - protein, 9 aa, Homo sapiens
ASSYSGEQY

SEQ ID NO: 1895 - protein, 11 aa, Homo sapiens
ASSLLLNTEAF

SEQ ID NO: 1896 - protein, 12 aa, Homo sapiens
ASSLGGATDTQY

SEQ ID NO: 1897 - protein, 13 aa, Homo sapiens
ASSLLAGSYNEQF

SEQ ID NO: 1898 - protein, 11 aa, Homo sapiens
ASSQGANTEAF

SEQ ID NO: 1899 - protein, 11 aa, Homo sapiens
ASSVGLNTEAF

SEQ ID NO: 1900 - protein, 9 aa, Homo sapiens
ASSYLYEQY

SEQ ID NO: 1901 - protein, 12 aa, Homo sapiens
ASSLGVSNQPQH

SEQ ID NO: 1902 - protein, 11 aa, Homo sapiens
ASSWGQNTEAF

SEQ ID NO: 1903 - protein, 11 aa, Homo sapiens
ASRTGGTDTQY

SEQ ID NO: 1904 - protein, 9 aa, Homo sapiens
ASSVADTQY

SEQ ID NO: 1905 - protein, 11 aa, Homo sapiens
ASSLDRGNEQF

SEQ ID NO: 1906 - protein, 10 aa, Homo sapiens
ASSRGTGELF

SEQ ID NO: 1907 - protein, 10 aa, Homo sapiens
ASRDSSYEQY

SEQ ID NO: 1908 - protein, 11 aa, Homo sapiens
ASSVTGNTEAF

SEQ ID NO: 1909 - protein, 11 aa, Homo sapiens
ASSSTANTEAF

SEQ ID NO: 1910 - protein, 13 aa, Homo sapiens
ASSSLAGGTDTQY

SEQ ID NO: 1911 - protein, 11 aa, Homo sapiens
ASSRGLQETQY

SEQ ID NO: 1912 - protein, 12 aa, Homo sapiens
ASSLLGSTDTQY

SEQ ID NO: 1913 - protein, 10 aa, Homo sapiens
ASSPDGYEQY

SEQ ID NO: 1914 - protein, 10 aa, Homo sapiens
ASSLARDTQY

SEQ ID NO: 1915 - protein, 12 aa, Homo sapiens
ASSLGGGADTQY

SEQ ID NO: 1916 - protein, 11 aa, Homo sapiens
ASSQGSYNEQF

SEQ ID NO: 1917 - protein, 11 aa, Homo sapiens
ASSLTGGETQY

SEQ ID NO: 1918 - protein, 11 aa, Homo sapiens
ASSPGTTYEQY

SEQ ID NO: 1919 - protein, 12 aa, Homo sapiens
ASSPGTANYGYT

SEQ ID NO: 1920 - protein, 11 aa, Homo sapiens
ASSFSSGNTIY

SEQ ID NO: 1921 - protein, 11 aa, Homo sapiens
ASSDRGNTEAF

SEQ ID NO: 1922 - protein, 10 aa, Homo sapiens
ASSLAGGEQY

SEQ ID NO: 1923 - protein, 11 aa, Homo sapiens
ASSPDRDTEAF

SEQ ID NO: 1924 - protein, 10 aa, Homo sapiens
ASSPLNQPQH

SEQ ID NO: 1925 - protein, 10 aa, Homo sapiens
ASSESSYEQY

SEQ ID NO: 1926 - protein, 11 aa, Homo sapiens
ASSPGGGYEQY

SEQ ID NO: 1927 - protein, 11 aa, Homo sapiens
ASRGQLNTEAF

SEQ ID NO: 1928 - protein, 11 aa, Homo sapiens
ASSRTGNYGYT

SEQ ID NO: 1929 - protein, 10 aa, Homo sapiens
ASSSNSYEQY

SEQ ID NO: 1930 - protein, 11 aa, Homo sapiens
ASSLGTEETQY

SEQ ID NO: 1931 - protein, 10 aa, Homo sapiens
ASSLVDTEAF

SEQ ID NO: 1932 - protein, 9 aa, Homo sapiens
SARDSYEQY

SEQ ID NO: 1933 - protein, 10 aa, Homo sapiens
ASSYSGTEAF

SEQ ID NO: 1934 - protein, 12 aa, Homo sapiens
ASSLGTENTEAF

SEQ ID NO: 1935 - protein, 11 aa, Homo sapiens
ASSYSSYNEQF

SEQ ID NO: 1936 - protein, 11 aa, Homo sapiens
ASSWTENTEAF

SEQ ID NO: 1937 - protein, 12 aa, Homo sapiens
ASSLGAGTDTQY

SEQ ID NO: 1938 - protein, 13 aa, Homo sapiens
ASSPTSGSTDTQY

SEQ ID NO: 1939 - protein, 9 aa, Homo sapiens
ASSPNYGYT

SEQ ID NO: 1940 - protein, 12 aa, Homo sapiens
ASSRDRSTDTQY

SEQ ID NO: 1941 - protein, 11 aa, Homo sapiens
ASSPQGDTEAF

SEQ ID NO: 1942 - protein, 9 aa, Homo sapiens
ASSTNTEAF

SEQ ID NO: 1943 - protein, 11 aa, Homo sapiens
ASSPGQNQPQH

SEQ ID NO: 1944 - protein, 11 aa, Homo sapiens
ASSQVGNTEAF

SEQ ID NO: 1945 - protein, 9 aa, Homo sapiens
ASSPLETQY

SEQ ID NO: 1946 - protein, 11 aa, Homo sapiens
ASSDRDTGELF

SEQ ID NO: 1947 - protein, 11 aa, Homo sapiens
ASSPTGGYEQY

SEQ ID NO: 1948 - protein, 10 aa, Homo sapiens
ASSPTGYGYT

SEQ ID NO: 1949 - protein, 11 aa, Homo sapiens
ASSVGGGTEAF

SEQ ID NO: 1950 - protein, 10 aa, Homo sapiens
ASSFRGETQY

SEQ ID NO: 1951 - protein, 13 aa, Homo sapiens
ASSLGLAAYNEQF

SEQ ID NO: 1952 - protein, 10 aa, Homo sapiens
ASSLDGETQY

SEQ ID NO: 1953 - protein, 9 aa, Homo sapiens
ASSDGYEQY

SEQ ID NO: 1954 - protein, 12 aa, Homo sapiens
ASSPGLAYNEQF

SEQ ID NO: 1955 - protein, 10 aa, Homo sapiens
ASSLIGETQY

SEQ ID NO: 1956 - protein, 10 aa, Homo sapiens
ASSRGDTEAF

SEQ ID NO: 1957 - protein, 11 aa, Homo sapiens
ASSSQMNTEAF

SEQ ID NO: 1958 - protein, 12 aa, Homo sapiens
ASSQDRGTDTQY

SEQ ID NO: 1959 - protein, 13 aa, Homo sapiens
ASSLTSGGTDTQY

SEQ ID NO: 1960 - protein, 12 aa, Homo sapiens
ASSFGGSYNEQF

SEQ ID NO: 1961 - protein, 10 aa, Homo sapiens
ASSLGPGELF

SEQ ID NO: 1962 - protein, 10 aa, Homo sapiens
ASSQDGETQY

SEQ ID NO: 1963 - protein, 11 aa, Homo sapiens
ASSLEGGQPQH

SEQ ID NO: 1964 - protein, 10 aa, Homo sapiens
ASSPVNTEAF

SEQ ID NO: 1965 - protein, 10 aa, Homo sapiens
ASSFGGQPQH

SEQ ID NO: 1966 - protein, 11 aa, Homo sapiens
ASSYGLNTEAF

SEQ ID NO: 1967 - protein, 12 aa, Homo sapiens
ASSPGTASYEQY

SEQ ID NO: 1968 - protein, 11 aa, Homo sapiens
ASSLGRGNEQF

SEQ ID NO: 1969 - protein, 10 aa, Homo sapiens
ASSLVGYGYT

SEQ ID NO: 1970 - protein, 9 aa, Homo sapiens
ASSPTYEQY

SEQ ID NO: 1971 - protein, 10 aa, Homo sapiens
ASSFRGYEQY

SEQ ID NO: 1972 - protein, 10 aa, Homo sapiens
ASSLDGNTIY

SEQ ID NO: 1973 - protein, 10 aa, Homo sapiens
ASSTGNQPQH

SEQ ID NO: 1974 - protein, 9 aa, Homo sapiens
ASSAGETQY

SEQ ID NO: 1975 - protein, 11 aa, Homo sapiens
ASSQGSSYEQY

SEQ ID NO: 1976 - protein, 12 aa, Homo sapiens
ASSLRDSSYEQY

SEQ ID NO: 1977 - protein, 12 aa, Homo sapiens
ASSLRQGTDTQY

SEQ ID NO: 1978 - protein, 11 aa, Homo sapiens
ASSPGSGNTIY

SEQ ID NO: 1979 - protein, 12 aa, Homo sapiens
ASSLQGGTDTQY

SEQ ID NO: 1980 - protein, 11 aa, Homo sapiens
ASSLTGGQPQH

SEQ ID NO: 1981 - protein, 11 aa, Homo sapiens
ASSLGVGTEAF

SEQ ID NO: 1982 - protein, 13 aa, Homo sapiens
ASSPGTSGSYEQY

SEQ ID NO: 1983 - protein, 10 aa, Homo sapiens
ASSRGYNEQF

SEQ ID NO: 1984 - protein, 10 aa, Homo sapiens
ASSPPNTEAF

SEQ ID NO: 1985 - protein, 13 aa, Homo sapiens
ASSLLAGAYNEQF

SEQ ID NO: 1986 - protein, 12 aa, Homo sapiens
ASSPDRLNTEAF

SEQ ID NO: 1987 - protein, 9 aa, Homo sapiens
ASSRAYEQY

SEQ ID NO: 1988 - protein, 11 aa, Homo sapiens
ASSGGSNQPQH

SEQ ID NO: 1989 - protein, 12 aa, Homo sapiens
ASSPGTGNYGYT

SEQ ID NO: 1990 - protein, 12 aa, Homo sapiens
ASSQDRGNQPQH

SEQ ID NO: 1991 - protein, 13 aa, Homo sapiens
ASSRTSGSYNEQF

SEQ ID NO: 1992 - protein, 14 aa, Homo sapiens
ASSPGLAGGTDTQY

SEQ ID NO: 1993 - protein, 9 aa, Homo sapiens
ASSLVTEAF

SEQ ID NO: 1994 - protein, 11 aa, Homo sapiens
ASSLLENTEAF

SEQ ID NO: 1995 - protein, 12 aa, Homo sapiens
ASSLTGGQETQY

SEQ ID NO: 1996 - protein, 8 aa, Homo sapiens
ASSGYEQY

SEQ ID NO: 1997 - protein, 12 aa, Homo sapiens
ASSLGQGSTEAF

SEQ ID NO: 1998 - protein, 10 aa, Homo sapiens
ASSLAPYEQY

SEQ ID NO: 1999 - protein, 11 aa, Homo sapiens
ASSFRGSYEQY

SEQ ID NO: 2000 - protein, 9 aa, Homo sapiens
ASSLIYEQY

SEQ ID NO: 2001 - protein, 10 aa, Homo sapiens
ASSFRGNEQF

SEQ ID NO: 2002 - protein, 11 aa, Homo sapiens
ASSRDGNTEAF

SEQ ID NO: 2003 - protein, 14 aa, Homo sapiens
ASSSGLAGGTDTQY

SEQ ID NO: 2004 - protein, 11 aa, Homo sapiens
ASSFPGTDTQY

SEQ ID NO: 2005 - protein, 11 aa, Homo sapiens
ASSFRGGTEAF

SEQ ID NO: 2006 - protein, 12 aa, Homo sapiens
ASSLGQGDTEAF

SEQ ID NO: 2007 - protein, 10 aa, Homo sapiens
ASSLLYNEQF

SEQ ID NO: 2008 - protein, 9 aa, Homo sapiens
ASSEAYEQY

SEQ ID NO: 2009 - protein, 9 aa, Homo sapiens
ASSLRGEQF

SEQ ID NO: 2010 - protein, 11 aa, Homo sapiens
ASSFTVNTEAF

SEQ ID NO: 2011 - protein, 11 aa, Homo sapiens
ASSLTGADTQY

SEQ ID NO: 2012 - protein, 12 aa, Homo sapiens
ASSLVGSYNEQF

SEQ ID NO: 2013 - protein, 11 aa, Homo sapiens
ASSPLSTDTQY

SEQ ID NO: 2014 - protein, 9 aa, Homo sapiens
ASSGTYEQY

SEQ ID NO: 2015 - protein, 12 aa, Homo sapiens
ASSSGGSTDTQY

SEQ ID NO: 2016 - protein, 12 aa, Homo sapiens
ASSLSGMNTEAF

SEQ ID NO: 2017 - protein, 12 aa, Homo sapiens
ASSPGTGYNEQF

SEQ ID NO: 2018 - protein, 9 aa, Homo sapiens
ASSSGGEQY

SEQ ID NO: 2019 - protein, 10 aa, Homo sapiens
ASSQGAYEQY

SEQ ID NO: 2020 - protein, 11 aa, Homo sapiens
ASSLVGGYEQY

SEQ ID NO: 2021 - protein, 10 aa, Homo sapiens
ASSGQGYGYT

SEQ ID NO: 2022 - protein, 12 aa, Homo sapiens
ASSPGTAYNEQF

SEQ ID NO: 2023 - protein, 11 aa, Homo sapiens
ASSDSSTDTQY

SEQ ID NO: 2024 - protein, 9 aa, Homo sapiens
ASSQVNEQF

SEQ ID NO: 2025 - protein, 12 aa, Homo sapiens
ASSLAGGAYEQY

SEQ ID NO: 2026 - protein, 11 aa, Homo sapiens
ASSLGRDYEQY

SEQ ID NO: 2027 - protein, 11 aa, Homo sapiens
ASSLGFTDTQY

SEQ ID NO: 2028 - protein, 11 aa, Homo sapiens
ASSLGWNTEAF

SEQ ID NO: 2029 - protein, 12 aa, Homo sapiens
ASSLGLNTGELF

SEQ ID NO: 2030 - protein, 9 aa, Homo sapiens
ASSFRYEQY

SEQ ID NO: 2031 - protein, 12 aa, Homo sapiens
ASSPGQANTEAF

SEQ ID NO: 2032 - protein, 10 aa, Homo sapiens
ASSGGNTEAF

SEQ ID NO: 2033 - protein, 11 aa, Homo sapiens
ASSLAGRETQY

SEQ ID NO: 2034 - protein, 10 aa, Homo sapiens
ASSFGQETQY

SEQ ID NO: 2035 - protein, 13 aa, Homo sapiens
ASSLAGGPTDTQY

SEQ ID NO: 2036 - protein, 9 aa, Homo sapiens
ASSYTGELF

SEQ ID NO: 2037 - protein, 10 aa, Homo sapiens
SARQGNQPQH

SEQ ID NO: 2038 - protein, 10 aa, Homo sapiens
ASSFSGNEQF

SEQ ID NO: 2039 - protein, 11 aa, Homo sapiens
ASSLEGYNEQF

SEQ ID NO: 2040 - protein, 10 aa, Homo sapiens
ASSPGDYGYT

SEQ ID NO: 2041 - protein, 10 aa, Homo sapiens
SARTGNQPQH

SEQ ID NO: 2042 - protein, 11 aa, Homo sapiens
ASSRDRDTEAF

SEQ ID NO: 2043 - protein, 9 aa, Homo sapiens
ASSVGYEQY

SEQ ID NO: 2044 - protein, 11 aa, Homo sapiens
ASSGGGTDTQY

SEQ ID NO: 2045 - protein, 11 aa, Homo sapiens
ASSLEGDQPQH

SEQ ID NO: 2046 - protein, 12 aa, Homo sapiens
SARLAGGQETQY

SEQ ID NO: 2047 - protein, 12 aa, Homo sapiens
ASSGGSSYNEQF

SEQ ID NO: 2048 - protein, 11 aa, Homo sapiens
ASSSSGTDTQY

SEQ ID NO: 2049 - protein, 11 aa, Homo sapiens
ASSQTVNTEAF

SEQ ID NO: 2050 - protein, 10 aa, Homo sapiens
ASSEGNTEAF

SEQ ID NO: 2051 - protein, 9 aa, Homo sapiens
ASSSLDTQY

SEQ ID NO: 2052 - protein, 12 aa, Homo sapiens
ASSQGQGAYEQY

SEQ ID NO: 2053 - protein, 12 aa, Homo sapiens
ASSLGQRNTEAF

SEQ ID NO: 2054 - protein, 11 aa, Homo sapiens
ASSFSENTEAF

SEQ ID NO: 2055 - protein, 10 aa, Homo sapiens
ASSSGGDTQY

SEQ ID NO: 2056 - protein, 12 aa, Homo sapiens
ASSLDSMNTEAF

SEQ ID NO: 2057 - protein, 10 aa, Homo sapiens
SARQGNTEAF

SEQ ID NO: 2058 - protein, 12 aa, Homo sapiens
ASSLGLAQETQY

SEQ ID NO: 2059 - protein, 9 aa, Homo sapiens
ASSQNNEQF

SEQ ID NO: 2060 - protein, 12 aa, Homo sapiens
ASSLGRSNQPQH

SEQ ID NO: 2061 - protein, 10 aa, Homo sapiens
ASSLGPNEQF

SEQ ID NO: 2062 - protein, 11 aa, Homo sapiens
ASSSPGTDTQY

SEQ ID NO: 2063 - protein, 11 aa, Homo sapiens
ASSFSRNTEAF

SEQ ID NO: 2064 - protein, 10 aa, Homo sapiens
ASSPGGQPQH

SEQ ID NO: 2065 - protein, 12 aa, Homo sapiens
ASSSQGSNQPQH

SEQ ID NO: 2066 - protein, 10 aa, Homo sapiens
ASSPLGYEQY

SEQ ID NO: 2067 - protein, 9 aa, Homo sapiens
ASSLDYGYT

SEQ ID NO: 2068 - protein, 11 aa, Homo sapiens
ASSLSGTYEQY

SEQ ID NO: 2069 - protein, 11 aa, Homo sapiens
ASSSGTAYEQY

SEQ ID NO: 2070 - protein, 11 aa, Homo sapiens
ASSRQVNTEAF

SEQ ID NO: 2071 - protein, 12 aa, Homo sapiens
ASSLDRGPYEQY

SEQ ID NO: 2072 - protein, 10 aa, Homo sapiens
ASSLQGQPQH

SEQ ID NO: 2073 - protein, 11 aa, Homo sapiens
ASSLSGGETQY

SEQ ID NO: 2074 - protein, 11 aa, Homo sapiens
ASSRGGQETQY

SEQ ID NO: 2075 - protein, 12 aa, Homo sapiens
ASSRDRGSYEQY

SEQ ID NO: 2076 - protein, 10 aa, Homo sapiens
ASRSSGNTIY

SEQ ID NO: 2077 - protein, 13 aa, Homo sapiens
ASSSGLAGYNEQF

SEQ ID NO: 2078 - protein, 12 aa, Homo sapiens
ASSLQGRNTEAF

SEQ ID NO: 2079 - protein, 11 aa, Homo sapiens
ASSLEGYTEAF

SEQ ID NO: 2080 - protein, 12 aa, Homo sapiens
ASSPGLAGNEQF

SEQ ID NO: 2081 - protein, 12 aa, Homo sapiens
ASSLQGPNTEAF

SEQ ID NO: 2082 - protein, 11 aa, Homo sapiens
ASSRDRGTEAF

SEQ ID NO: 2083 - protein, 10 aa, Homo sapiens
ASSEGTDTQY

SEQ ID NO: 2084 - protein, 11 aa, Homo sapiens
ASSFGQNYGYT

SEQ ID NO: 2085 - protein, 12 aa, Homo sapiens
ASSGTSGYNEQF

SEQ ID NO: 2086 - protein, 11 aa, Homo sapiens
ASSATGNTEAF

SEQ ID NO: 2087 - protein, 12 aa, Homo sapiens
ASSLVGGQETQY

SEQ ID NO: 2088 - protein, 12 aa, Homo sapiens
ASSPTGSTDTQY

SEQ ID NO: 2089 - protein, 12 aa, Homo sapiens
ASSLGDSSYEQY

SEQ ID NO: 2090 - protein, 11 aa, Homo sapiens
ASSLGTNQPQH

SEQ ID NO: 2091 - protein, 12 aa, Homo sapiens
ASSLQGAGTEAF

SEQ ID NO: 2092 - protein, 11 aa, Homo sapiens
ASSRQGAYEQY

SEQ ID NO: 2093 - protein, 9 aa, Homo sapiens
ASSFNNEQF

SEQ ID NO: 2094 - protein, 10 aa, Homo sapiens
ASSFGYNEQF

SEQ ID NO: 2095 - protein, 11 aa, Homo sapiens
ASSWTANTEAF

SEQ ID NO: 2096 - protein, 12 aa, Homo sapiens
ASSPGQGGQPQH

SEQ ID NO: 2097 - protein, 12 aa, Homo sapiens
ASSFGGMNTEAF

SEQ ID NO: 2098 - protein, 10 aa, Homo sapiens
ASSLKNTEAF

SEQ ID NO: 2099 - protein, 9 aa, Homo sapiens
ASSRRETQY

SEQ ID NO: 2100 - protein, 11 aa, Homo sapiens
ASSLEPNTEAF

SEQ ID NO: 2101 - protein, 9 aa, Homo sapiens
ASSFDNEQF

SEQ ID NO: 2102 - protein, 9 aa, Homo sapiens
ASSFLNEQF

SEQ ID NO: 2103 - protein, 11 aa, Homo sapiens
ASSRDSNTEAF

SEQ ID NO: 2104 - protein, 10 aa, Homo sapiens
ASSSSGYEQY

SEQ ID NO: 2105 - protein, 11 aa, Homo sapiens
ASSPPGADTQY

SEQ ID NO: 2106 - protein, 11 aa, Homo sapiens
ASSLSGDQPQH

SEQ ID NO: 2107 - protein, 10 aa, Homo sapiens
ASSLENQPQH

SEQ ID NO: 2108 - protein, 11 aa, Homo sapiens
ASSLRNTGELF

SEQ ID NO: 2109 - protein, 11 aa, Homo sapiens
ASSPGQGTEAF

SEQ ID NO: 2110 - protein, 10 aa, Homo sapiens
ASSSGAYEQY

SEQ ID NO: 2111 - protein, 11 aa, Homo sapiens
ASSQGSGNTIY

SEQ ID NO: 2112 - protein, 10 aa, Homo sapiens
ASSPQGYGYT

SEQ ID NO: 2113 - protein, 11 aa, Homo sapiens
ASSLGPNNEQF

SEQ ID NO: 2114 - protein, 11 aa, Homo sapiens
ASSSQENTEAF

SEQ ID NO: 2115 - protein, 11 aa, Homo sapiens
ASSYSSTDTQY

SEQ ID NO: 2116 - protein, 10 aa, Homo sapiens
ASSLQGETQY

SEQ ID NO: 2117 - protein, 11 aa, Homo sapiens
ASSLQGATEAF

SEQ ID NO: 2118 - protein, 11 aa, Homo sapiens
ASSLLSNQPQH

SEQ ID NO: 2119 - protein, 9 aa, Homo sapiens
ASTGNTEAF

SEQ ID NO: 2120 - protein, 11 aa, Homo sapiens
ASRGSSYNEQF

SEQ ID NO: 2121 - protein, 10 aa, Homo sapiens
ASSPGSDTQY

SEQ ID NO: 2122 - protein, 8 aa, Homo sapiens
ASGQETQY

SEQ ID NO: 2123 - protein, 12 aa, Homo sapiens
ASSLDRSSYEQY

SEQ ID NO: 2124 - protein, 10 aa, Homo sapiens
ASSQGDQPQH

SEQ ID NO: 2125 - protein, 11 aa, Homo sapiens
ASSLGGGDTQY

SEQ ID NO: 2126 - protein, 10 aa, Homo sapiens
ASRRGNTEAF

SEQ ID NO: 2127 - protein, 12 aa, Homo sapiens
ASSPDSSNQPQH

SEQ ID NO: 2128 - protein, 10 aa, Homo sapiens
ASSLTADTQY

SEQ ID NO: 2129 - protein, 11 aa, Homo sapiens
ASSLQNTGELF

SEQ ID NO: 2130 - protein, 10 aa, Homo sapiens
ASSSSQETQY

SEQ ID NO: 2131 - protein, 12 aa, Homo sapiens
ASSPGLAGDTQY

SEQ ID NO: 2132 - protein, 9 aa, Homo sapiens
ASSDRYEQY

SEQ ID NO: 2133 - protein, 11 aa, Homo sapiens
ASRGQGTDTQY

SEQ ID NO: 2134 - protein, 11 aa, Homo sapiens
ASSSNSNQPQH

SEQ ID NO: 2135 - protein, 9 aa, Homo sapiens
ASSPGGTQY

SEQ ID NO: 2136 - protein, 12 aa, Homo sapiens
ASSRDRSSYEQY

SEQ ID NO: 2137 - protein, 12 aa, Homo sapiens
ASSLEGGTDTQY

SEQ ID NO: 2138 - protein, 11 aa, Homo sapiens
ASSFRGQETQY

SEQ ID NO: 2139 - protein, 11 aa, Homo sapiens
ASSRDRTYEQY

SEQ ID NO: 2140 - protein, 12 aa, Homo sapiens
ASSPQGANTEAF

SEQ ID NO: 2141 - protein, 9 aa, Homo sapiens
ASRDSYEQY

SEQ ID NO: 2142 - protein, 12 aa, Homo sapiens
ASSLGTGNYGYT

SEQ ID NO: 2143 - protein, 11 aa, Homo sapiens
ASSPRGPDTQY

SEQ ID NO: 2144 - protein, 9 aa, Homo sapiens
ASSDTYEQY

SEQ ID NO: 2145 - protein, 9 aa, Homo sapiens
ASSYGNEQF

SEQ ID NO: 2146 - protein, 12 aa, Homo sapiens
ASSLGTANYGYT

SEQ ID NO: 2147 - protein, 10 aa, Homo sapiens
ASSDRGYEQY

SEQ ID NO: 2148 - protein, 11 aa, Homo sapiens
ASSQTGGTEAF

SEQ ID NO: 2149 - protein, 13 aa, Homo sapiens
ASSPGLAGGNEQF

SEQ ID NO: 2150 - protein, 9 aa, Homo sapiens
ASSQGGEQF

SEQ ID NO: 2151 - protein, 12 aa, Homo sapiens
ASSLSGLNTEAF

SEQ ID NO: 2152 - protein, 10 aa, Homo sapiens
ASSRGGYEQY

SEQ ID NO: 2153 - protein, 12 aa, Homo sapiens
ASSPRTSTDTQY

SEQ ID NO: 2154 - protein, 10 aa, Homo sapiens
ASSVGNTEAF

SEQ ID NO: 2155 - protein, 13 aa, Homo sapiens
ASSSGLAGTDTQY

SEQ ID NO: 2156 - protein, 13 aa, Homo sapiens
ASSLGGGSTDTQY

SEQ ID NO: 2157 - protein, 12 aa, Homo sapiens
ASSPTGSSYEQY

SEQ ID NO: 2158 - protein, 10 aa, Homo sapiens
ASSRGADTQY

SEQ ID NO: 2159 - protein, 12 aa, Homo sapiens
ASSLGPNTGELF

SEQ ID NO: 2160 - protein, 11 aa, Homo sapiens
ASSLARGTEAF

SEQ ID NO: 2161 - protein, 11 aa, Homo sapiens
ASSPDRAYEQY

SEQ ID NO: 2162 - protein, 10 aa, Homo sapiens
ASSQVADTQY

SEQ ID NO: 2163 - protein, 8 aa, Homo sapiens
ASRGETQY

SEQ ID NO: 2164 - protein, 11 aa, Homo sapiens
ASSEGSNQPQH

SEQ ID NO: 2165 - protein, 10 aa, Homo sapiens
ASRGGTDTQY

SEQ ID NO: 2166 - protein, 11 aa, Homo sapiens
ASSFSGQETQY

SEQ ID NO: 2167 - protein, 10 aa, Homo sapiens
ASSFDSYEQY

SEQ ID NO: 2168 - protein, 10 aa, Homo sapiens
ASSIGGTEAF

SEQ ID NO: 2169 - protein, 12 aa, Homo sapiens
ASSPGLAEETQY

SEQ ID NO: 2170 - protein, 9 aa, Homo sapiens
ASSAAYEQY

SEQ ID NO: 2171 - protein, 9 aa, Homo sapiens
ASSFSGELF

SEQ ID NO: 2172 - protein, 11 aa, Homo sapiens
ASSLSPSYEQY

SEQ ID NO: 2173 - protein, 12 aa, Homo sapiens
ASSLGQGNEKLF

SEQ ID NO: 2174 - protein, 13 aa, Homo sapiens
ASSLGGASTDTQY

SEQ ID NO: 2175 - protein, 11 aa, Homo sapiens
ASSSTGSYEQY

SEQ ID NO: 2176 - protein, 9 aa, Homo sapiens
ASSPLDTQY

SEQ ID NO: 2177 - protein, 12 aa, Homo sapiens
ASSSGQMNTEAF

SEQ ID NO: 2178 - protein, 10 aa, Homo sapiens
ASSPPGNEQF

SEQ ID NO: 2179 - protein, 10 aa, Homo sapiens
ASSQGPDTQY

SEQ ID NO: 2180 - protein, 10 aa, Homo sapiens
ASSGGSYEQY

SEQ ID NO: 2181 - protein, 12 aa, Homo sapiens
ASSLGLAYNEQF

SEQ ID NO: 2182 - protein, 10 aa, Homo sapiens
ASSNSNQPQH

SEQ ID NO: 2183 - protein, 9 aa, Homo sapiens
ASRNTGELF

SEQ ID NO: 2184 - protein, 10 aa, Homo sapiens
ASSRSYNEQF

SEQ ID NO: 2185 - protein, 10 aa, Homo sapiens
ASSQVTDTQY

SEQ ID NO: 2186 - protein, 10 aa, Homo sapiens
ASSLGGNEQY

SEQ ID NO: 2187 - protein, 9 aa, Homo sapiens
ASSSSETQY

SEQ ID NO: 2188 - protein, 10 aa, Homo sapiens
ASSQVNTEAF

SEQ ID NO: 2189 - protein, 12 aa, Homo sapiens
ASSPPGQGYEQY

SEQ ID NO: 2190 - protein, 11 aa, Homo sapiens
ASSYSENTEAF

SEQ ID NO: 2191 - protein, 9 aa, Homo sapiens
SARGGYEQY

SEQ ID NO: 2192 - protein, 9 aa, Homo sapiens
ASSLRDEQY

SEQ ID NO: 2193 - protein, 12 aa, Homo sapiens
ASSPGQVNTEAF

SEQ ID NO: 2194 - protein, 11 aa, Homo sapiens
ASSLTGEETQY

SEQ ID NO: 2195 - protein, 10 aa, Homo sapiens
ASSSRNTEAF

SEQ ID NO: 2196 - protein, 11 aa, Homo sapiens
ASSFRSTDTQY

SEQ ID NO: 2197 - protein, 9 aa, Homo sapiens
ASSFTGELF

SEQ ID NO: 2198 - protein, 11 aa, Homo sapiens
ASSYSRGTEAF

SEQ ID NO: 2199 - protein, 9 aa, Homo sapiens
ASSFAYEQY

SEQ ID NO: 2200 - protein, 11 aa, Homo sapiens
ASSRQGNYGYT

SEQ ID NO: 2201 - protein, 10 aa, Homo sapiens
ASSYSYNEQF

SEQ ID NO: 2202 - protein, 12 aa, Homo sapiens
ASSLQGNTGELF

SEQ ID NO: 2203 - protein, 12 aa, Homo sapiens
ASSPRTANTEAF

SEQ ID NO: 2204 - protein, 11 aa, Homo sapiens
ASSPGTTDTQY

SEQ ID NO: 2205 - protein, 8 aa, Homo sapiens
ASGYNEQF

SEQ ID NO: 2206 - protein, 11 aa, Homo sapiens
ASSLGNTDTQY

SEQ ID NO: 2207 - protein, 13 aa, Homo sapiens
ASSSGTSGTDTQY

SEQ ID NO: 2208 - protein, 11 aa, Homo sapiens
ASSQDRAYEQY

SEQ ID NO: 2209 - protein, 10 aa, Homo sapiens
ASSTGTDTQY

SEQ ID NO: 2210 - protein, 10 aa, Homo sapiens
ASSQEGYEQY

SEQ ID NO: 2211 - protein, 10 aa, Homo sapiens
ASSLGVDTQY

SEQ ID NO: 2212 - protein, 13 aa, Homo sapiens
ASSPTSGGYNEQF

SEQ ID NO: 2213 - protein, 10 aa, Homo sapiens
ASSLDGDTQY

SEQ ID NO: 2214 - protein, 9 aa, Homo sapiens
ASSATYEQY

SEQ ID NO: 2215 - protein, 10 aa, Homo sapiens
ASSPPYNEQF

SEQ ID NO: 2216 - protein, 10 aa, Homo sapiens
ASSLTNQPQH

SEQ ID NO: 2217 - protein, 10 aa, Homo sapiens
ASSLTAYEQY

SEQ ID NO: 2218 - protein, 12 aa, Homo sapiens
ASSQGGGNQPQH

SEQ ID NO: 2219 - protein, 11 aa, Homo sapiens
ASSLVGGETQY

SEQ ID NO: 2220 - protein, 11 aa, Homo sapiens
ASSRQGQETQY

SEQ ID NO: 2221 - protein, 11 aa, Homo sapiens
ASSLSGAYEQY

SEQ ID NO: 2222 - protein, 11 aa, Homo sapiens
ASSSGLYNEQF

SEQ ID NO: 2223 - protein, 11 aa, Homo sapiens
ASSLMGNTEAF

SEQ ID NO: 2224 - protein, 9 aa, Homo sapiens
ASRNTDTQY

SEQ ID NO: 2225 - protein, 11 aa, Homo sapiens
ASSLGGSDTQY

SEQ ID NO: 2226 - protein, 10 aa, Homo sapiens
ASSPPQETQY

SEQ ID NO: 2227 - protein, 12 aa, Homo sapiens
ASSLTGTNTEAF

SEQ ID NO: 2228 - protein, 12 aa, Homo sapiens
ASSLASGSYEQY

SEQ ID NO: 2229 - protein, 11 aa, Homo sapiens
ASSLEGDTEAF

SEQ ID NO: 2230 - protein, 11 aa, Homo sapiens
ASSQDRGYGYT

SEQ ID NO: 2231 - protein, 11 aa, Homo sapiens
ASSLASGNTIY

SEQ ID NO: 2232 - protein, 12 aa, Homo sapiens
ASSPGGMNTEAF

SEQ ID NO: 2233 - protein, 11 aa, Homo sapiens
ASSTTGNTEAF

SEQ ID NO: 2234 - protein, 10 aa, Homo sapiens
ASSFRNQPQH

SEQ ID NO: 2235 - protein, 12 aa, Homo sapiens
ASSPGSSGNTIY

SEQ ID NO: 2236 - protein, 12 aa, Homo sapiens
ASSLSGGYNEQF

SEQ ID NO: 2237 - protein, 11 aa, Homo sapiens
ASSLRQGYEQY

SEQ ID NO: 2238 - protein, 10 aa, Homo sapiens
ASRGSGNTIY

SEQ ID NO: 2239 - protein, 10 aa, Homo sapiens
ASSRTTDTQY

SEQ ID NO: 2240 - protein, 12 aa, Homo sapiens
ASSSGQGPYEQY

SEQ ID NO: 2241 - protein, 10 aa, Homo sapiens
ASSGSYNEQF

SEQ ID NO: 2242 - protein, 11 aa, Homo sapiens
ASSQGQNYGYT

SEQ ID NO: 2243 - protein, 12 aa, Homo sapiens
ASSLLGGTDTQY

SEQ ID NO: 2244 - protein, 10 aa, Homo sapiens
ASSLVTGELF

SEQ ID NO: 2245 - protein, 12 aa, Homo sapiens
ASSLGQGGYGYT

SEQ ID NO: 2246 - protein, 12 aa, Homo sapiens
ASSPGTSSYEQY

SEQ ID NO: 2247 - protein, 10 aa, Homo sapiens
ASSTNTGELF

SEQ ID NO: 2248 - protein, 10 aa, Homo sapiens
ASSSRGTEAF

SEQ ID NO: 2249 - protein, 10 aa, Homo sapiens
ASSPGPDTQY

SEQ ID NO: 2250 - protein, 8 aa, Homo sapiens
ASRGTEAF

SEQ ID NO: 2251 - protein, 12 aa, Homo sapiens
ASSQGQGNTEAF

SEQ ID NO: 2252 - protein, 11 aa, Homo sapiens
ASSLRPNTEAF

SEQ ID NO: 2253 - protein, 10 aa, Homo sapiens
ASSLDRNEQF

SEQ ID NO: 2254 - protein, 10 aa, Homo sapiens
ASSPDRYEQY

SEQ ID NO: 2255 - protein, 11 aa, Homo sapiens
ASSSQVNTEAF

SEQ ID NO: 2256 - protein, 9 aa, Homo sapiens
ASSLMETQY

SEQ ID NO: 2257 - protein, 10 aa, Homo sapiens
ASSSGNYGYT

SEQ ID NO: 2258 - protein, 11 aa, Homo sapiens
ASSSDSTDTQY

SEQ ID NO: 2259 - protein, 11 aa, Homo sapiens
ASSSQGDTEAF

SEQ ID NO: 2260 - protein, 13 aa, Homo sapiens
ASSLDRSSYNEQF

SEQ ID NO: 2261 - protein, 9 aa, Homo sapiens
ASSFAETQY

SEQ ID NO: 2262 - protein, 12 aa, Homo sapiens
ASSSGGSNQPQH

SEQ ID NO: 2263 - protein, 11 aa, Homo sapiens
ASSLAVQETQY

SEQ ID NO: 2264 - protein, 12 aa, Homo sapiens
ASSRTGGNTEAF

SEQ ID NO: 2265 - protein, 11 aa, Homo sapiens
ASSLQGTGELF

SEQ ID NO: 2266 - protein, 12 aa, Homo sapiens
ASSSTGSNQPQH

SEQ ID NO: 2267 - protein, 11 aa, Homo sapiens
ASSYSGGYEQY

SEQ ID NO: 2268 - protein, 10 aa, Homo sapiens
ASSRDYNEQF

SEQ ID NO: 2269 - protein, 11 aa, Homo sapiens
ASSLDQNTEAF

SEQ ID NO: 2270 - protein, 10 aa, Homo sapiens
ASSPPGYEQY

SEQ ID NO: 2271 - protein, 11 aa, Homo sapiens
ASSRTGDQPQH

SEQ ID NO: 2272 - protein, 11 aa, Homo sapiens
ASSLLRNTEAF

SEQ ID NO: 2273 - protein, 10 aa, Homo sapiens
ASSYGGYEQY

SEQ ID NO: 2274 - protein, 9 aa, Homo sapiens
ASSEGYGYT

SEQ ID NO: 2275 - protein, 10 aa, Homo sapiens
ASSQGDYGYT

SEQ ID NO: 2276 - protein, 12 aa, Homo sapiens
ASSPTGSGNTIY

SEQ ID NO: 2277 - protein, 10 aa, Homo sapiens
ASSRDQETQY

SEQ ID NO: 2278 - protein, 12 aa, Homo sapiens
ASSLGGPTDTQY

SEQ ID NO: 2279 - protein, 11 aa, Homo sapiens
ASSPLGTDTQY

SEQ ID NO: 2280 - protein, 11 aa, Homo sapiens
ASSLGGVTEAF

SEQ ID NO: 2281 - protein, 11 aa, Homo sapiens
ASSADSNQPQH

SEQ ID NO: 2282 - protein, 12 aa, Homo sapiens
ASSLEGGNTEAF

SEQ ID NO: 2283 - protein, 11 aa, Homo sapiens
ASSPGTDYEQY

SEQ ID NO: 2284 - protein, 12 aa, Homo sapiens
ASSLGRNTGELF

SEQ ID NO: 2285 - protein, 11 aa, Homo sapiens
ASSYGGSYEQY

SEQ ID NO: 2286 - protein, 10 aa, Homo sapiens
ASSLGNYEQY

SEQ ID NO: 2287 - protein, 11 aa, Homo sapiens
ASSLTGANVLT

SEQ ID NO: 2288 - protein, 10 aa, Homo sapiens
ASSSTGYGYT

SEQ ID NO: 2289 - protein, 13 aa, Homo sapiens
ASSPGTGSYNEQF

SEQ ID NO: 2290 - protein, 8 aa, Homo sapiens
ASGTYEQY

SEQ ID NO: 2291 - protein, 11 aa, Homo sapiens
ASSLVNTGELF

SEQ ID NO: 2292 - protein, 11 aa, Homo sapiens
ASSFGQQETQY

SEQ ID NO: 2293 - protein, 12 aa, Homo sapiens
ASSLAGSQETQY

SEQ ID NO: 2294 - protein, 12 aa, Homo sapiens
ASSPTGGNTEAF

SEQ ID NO: 2295 - protein, 12 aa, Homo sapiens
ASSLVGLNTEAF

SEQ ID NO: 2296 - protein, 9 aa, Homo sapiens
ASRGQETQY

SEQ ID NO: 2297 - protein, 11 aa, Homo sapiens
ASSFPSTDTQY

SEQ ID NO: 2298 - protein, 11 aa, Homo sapiens
ASSSDRGYEQY

SEQ ID NO: 2299 - protein, 11 aa, Homo sapiens
ASSPTGTYEQY

SEQ ID NO: 2300 - protein, 10 aa, Homo sapiens
ASSAGNTEAF

SEQ ID NO: 2301 - protein, 10 aa, Homo sapiens
ASSRDGYEQY

SEQ ID NO: 2302 - protein, 11 aa, Homo sapiens
ASSLGRADTQY

SEQ ID NO: 2303 - protein, 11 aa, Homo sapiens
ASSLEGADTQY

SEQ ID NO: 2304 - protein, 12 aa, Homo sapiens
ASSPTSGTDTQY

SEQ ID NO: 2305 - protein, 12 aa, Homo sapiens
ASSFGTANTEAF

SEQ ID NO: 2306 - protein, 10 aa, Homo sapiens
ASSLKGYEQY

SEQ ID NO: 2307 - protein, 11 aa, Homo sapiens
ASSLYRNTEAF

SEQ ID NO: 2308 - protein, 11 aa, Homo sapiens
ASSLAGPDTQY

SEQ ID NO: 2309 - protein, 11 aa, Homo sapiens
ASSPRRNTEAF

SEQ ID NO: 2310 - protein, 11 aa, Homo sapiens
ASSLTGGNEQF

SEQ ID NO: 2311 - protein, 9 aa, Homo sapiens
ASRKNTEAF

SEQ ID NO: 2312 - protein, 11 aa, Homo sapiens
ASSQDSTDTQY

SEQ ID NO: 2313 - protein, 10 aa, Homo sapiens
ASSLVGNTIY

SEQ ID NO: 2314 - protein, 11 aa, Homo sapiens
ASSPGLNQPQH

SEQ ID NO: 2315 - protein, 11 aa, Homo sapiens
ASSSGTSYEQY

SEQ ID NO: 2316 - protein, 11 aa, Homo sapiens
ASSLQGRTEAF

SEQ ID NO: 2317 - protein, 11 aa, Homo sapiens
ASSLDRADTQY

SEQ ID NO: 2318 - protein, 11 aa, Homo sapiens
ASSPQGSYEQY

SEQ ID NO: 2319 - protein, 13 aa, Homo sapiens
ASSPTGSSYNEQF

SEQ ID NO: 2320 - protein, 9 aa, Homo sapiens
ASRDYNEQF

SEQ ID NO: 2321 - protein, 11 aa, Homo sapiens
ASSSGPYNEQF

SEQ ID NO: 2322 - protein, 11 aa, Homo sapiens
ASSIQGNTEAF

SEQ ID NO: 2323 - protein, 12 aa, Homo sapiens
ASSRGGSYNEQF

SEQ ID NO: 2324 - protein, 12 aa, Homo sapiens
ASSYSGGNTEAF

SEQ ID NO: 2325 - protein, 9 aa, Homo sapiens
ASSRNYEQY

SEQ ID NO: 2326 - protein, 11 aa, Homo sapiens
ASSVDRNTEAF

SEQ ID NO: 2327 - protein, 10 aa, Homo sapiens
ASSHSTDTQY

SEQ ID NO: 2328 - protein, 12 aa, Homo sapiens
ASSFGTGGYEQY

SEQ ID NO: 2329 - protein, 12 aa, Homo sapiens
ASSPGTAGNTIY

SEQ ID NO: 2330 - protein, 11 aa, Homo sapiens
ASSLGHQETQY

SEQ ID NO: 2331 - protein, 12 aa, Homo sapiens
ASSLGGAGNTIY

SEQ ID NO: 2332 - protein, 10 aa, Homo sapiens
ASSLARNEQF

SEQ ID NO: 2333 - protein, 13 aa, Homo sapiens
ASSLEGYSNQPQH

SEQ ID NO: 2334 - protein, 9 aa, Homo sapiens
ASSSLNEQF

SEQ ID NO: 2335 - protein, 9 aa, Homo sapiens
ASSFPDTQY

SEQ ID NO: 2336 - protein, 11 aa, Homo sapiens
ASSQGENTEAF

SEQ ID NO: 2337 - protein, 12 aa, Homo sapiens
ASSPQGSGNTIY

SEQ ID NO: 2338 - protein, 10 aa, Homo sapiens
ASSPGDTEAF

SEQ ID NO: 2339 - protein, 11 aa, Homo sapiens
ASSQDRGNEQF

SEQ ID NO: 2340 - protein, 11 aa, Homo sapiens
ASSPTGDQPQH

SEQ ID NO: 2341 - protein, 11 aa, Homo sapiens
ASSYSRGYEQY

SEQ ID NO: 2342 - protein, 11 aa, Homo sapiens
ASSLLGDTEAF

SEQ ID NO: 2343 - protein, 11 aa, Homo sapiens
ASRRTGNTEAF

SEQ ID NO: 2344 - protein, 12 aa, Homo sapiens
ASSLLAGYNEQF

SEQ ID NO: 2345 - protein, 13 aa, Homo sapiens
ASSLAGASTDTQY

SEQ ID NO: 2346 - protein, 12 aa, Homo sapiens
ASSLTGPNTEAF

SEQ ID NO: 2347 - protein, 10 aa, Homo sapiens
ASSFSGTEAF

SEQ ID NO: 2348 - protein, 12 aa, Homo sapiens
ASSLQGAGNTIY

SEQ ID NO: 2349 - protein, 11 aa, Homo sapiens
ASSLGGSQPQH

SEQ ID NO: 2350 - protein, 11 aa, Homo sapiens
ASSDRGTDTQY

SEQ ID NO: 2351 - protein, 12 aa, Homo sapiens
ASSLAGAQETQY

SEQ ID NO: 2352 - protein, 9 aa, Homo sapiens
ASSLSYGYT

SEQ ID NO: 2353 - protein, 10 aa, Homo sapiens
ASSLEGNTIY

SEQ ID NO: 2354 - protein, 12 aa, Homo sapiens
ASSLAGGTGELF

SEQ ID NO: 2355 - protein, 13 aa, Homo sapiens
ASSPGQGGNQPQH

SEQ ID NO: 2356 - protein, 13 aa, Homo sapiens
ASSLGLAGVNEQF

SEQ ID NO: 2357 - protein, 11 aa, Homo sapiens
ASSLLGSYEQY

SEQ ID NO: 2358 - protein, 10 aa, Homo sapiens
ASSSGGNEQF

SEQ ID NO: 2359 - protein, 11 aa, Homo sapiens
ASSPSSNQPQH

SEQ ID NO: 2360 - protein, 12 aa, Homo sapiens
ASSGTSGTDTQY

SEQ ID NO: 2361 - protein, 10 aa, Homo sapiens
ASRSSTDTQY

SEQ ID NO: 2362 - protein, 11 aa, Homo sapiens
ASSPGRNQPQH

SEQ ID NO: 2363 - protein, 11 aa, Homo sapiens
ASSYSGSYEQY

SEQ ID NO: 2364 - protein, 9 aa, Homo sapiens
ASSFNYEQY

SEQ ID NO: 2365 - protein, 11 aa, Homo sapiens
ASSVGSNQPQH

SEQ ID NO: 2366 - protein, 11 aa, Homo sapiens
ASSTDRNTEAF

SEQ ID NO: 2367 - protein, 10 aa, Homo sapiens
SARGSNQPQH

SEQ ID NO: 2368 - protein, 12 aa, Homo sapiens
ASSLGQSNTEAF

SEQ ID NO: 2369 - protein, 10 aa, Homo sapiens
ASSPGEETQY

SEQ ID NO: 2370 - protein, 11 aa, Homo sapiens
ASSLAPTDTQY

SEQ ID NO: 2371 - protein, 10 aa, Homo sapiens
ASSQDRYEQY

SEQ ID NO: 2372 - protein, 11 aa, Homo sapiens
ASSRYSNQPQH

SEQ ID NO: 2373 - protein, 13 aa, Homo sapiens
ASSLAGGTYNEQF

SEQ ID NO: 2374 - protein, 11 aa, Homo sapiens
ASSYSVNTEAF

SEQ ID NO: 2375 - protein, 11 aa, Homo sapiens
ASRGQMNTEAF

SEQ ID NO: 2376 - protein, 11 aa, Homo sapiens
ASSYRGTDTQY

SEQ ID NO: 2377 - protein, 13 aa, Homo sapiens
ASSLGGGSNQPQH

SEQ ID NO: 2378 - protein, 10 aa, Homo sapiens
ASSPRSYEQY

SEQ ID NO: 2379 - protein, 12 aa, Homo sapiens
ASSLGTASYEQY

SEQ ID NO: 2380 - protein, 12 aa, Homo sapiens
ASSPRQGNQPQH

SEQ ID NO: 2381 - protein, 10 aa, Homo sapiens
ASSSQGYGYT

SEQ ID NO: 2382 - protein, 11 aa, Homo sapiens
ASSLDLTDTQY

SEQ ID NO: 2383 - protein, 10 aa, Homo sapiens
ASSLDRGEQY

SEQ ID NO: 2384 - protein, 10 aa, Homo sapiens
ASSYSNTEAF

SEQ ID NO: 2385 - protein, 12 aa, Homo sapiens
ASSPRGGNQPQH

SEQ ID NO: 2386 - protein, 12 aa, Homo sapiens
ASSLGVSGNTIY

SEQ ID NO: 2387 - protein, 11 aa, Homo sapiens
ASSSGQAYEQY

SEQ ID NO: 2388 - protein, 11 aa, Homo sapiens
ASSYGGTDTQY

SEQ ID NO: 2389 - protein, 12 aa, Homo sapiens
ASSPTGGSYEQY

SEQ ID NO: 2390 - protein, 13 aa, Homo sapiens
ASSLVAGGTDTQY

SEQ ID NO: 2391 - protein, 11 aa, Homo sapiens
ASSRGQGYEQY

SEQ ID NO: 2392 - protein, 12 aa, Homo sapiens
ASSRDRVNTEAF

SEQ ID NO: 2393 - protein, 13 aa, Homo sapiens
ASSYSGSSYNEQF

SEQ ID NO: 2394 - protein, 9 aa, Homo sapiens
ASRGSYEQY

SEQ ID NO: 2395 - protein, 10 aa, Homo sapiens
ASSQTGYEQY

SEQ ID NO: 2396 - protein, 10 aa, Homo sapiens
ASSYGSYEQY

SEQ ID NO: 2397 - protein, 10 aa, Homo sapiens
ASSPLADTQY

SEQ ID NO: 2398 - protein, 14 aa, Homo sapiens
ASSLGLAGGQETQY

SEQ ID NO: 2399 - protein, 11 aa, Homo sapiens
ASSSGSGNTIY

SEQ ID NO: 2400 - protein, 11 aa, Homo sapiens
ASSRDLNTEAF

SEQ ID NO: 2401 - protein, 11 aa, Homo sapiens
ASSQDSSYEQY

SEQ ID NO: 2402 - protein, 12 aa, Homo sapiens
ASSPRTVNTEAF

SEQ ID NO: 2403 - protein, 12 aa, Homo sapiens
ASSPTGVNTEAF

SEQ ID NO: 2404 - protein, 11 aa, Homo sapiens
ASRGSGANVLT

SEQ ID NO: 2405 - protein, 11 aa, Homo sapiens
ASSLNGNQPQH

SEQ ID NO: 2406 - protein, 11 aa, Homo sapiens
ASSLGQKETQY

SEQ ID NO: 2407 - protein, 11 aa, Homo sapiens
ASSLAASYEQY

SEQ ID NO: 2408 - protein, 10 aa, Homo sapiens
ASSLWGNEQF

SEQ ID NO: 2409 - protein, 12 aa, Homo sapiens
ASSLVGSGNTIY

SEQ ID NO: 2410 - protein, 11 aa, Homo sapiens
ASSLRGYNEQF

SEQ ID NO: 2411 - protein, 11 aa, Homo sapiens
ASSQSSYNEQF

SEQ ID NO: 2412 - protein, 12 aa, Homo sapiens
ASSSTGLNTEAF

SEQ ID NO: 2413 - protein, 12 aa, Homo sapiens
ASSLAGGGETQY

SEQ ID NO: 2414 - protein, 11 aa, Homo sapiens
ASSFQENTEAF

SEQ ID NO: 2415 - protein, 13 aa, Homo sapiens
ASSELAGGTDTQY

SEQ ID NO: 2416 - protein, 12 aa, Homo sapiens
ASSPGTVQETQY

SEQ ID NO: 2417 - protein, 13 aa, Homo sapiens
ASSLEGSSYNEQF

SEQ ID NO: 2418 - protein, 10 aa, Homo sapiens
ASSLPGQPQH

SEQ ID NO: 2419 - protein, 9 aa, Homo sapiens
ASSERETQY

SEQ ID NO: 2420 - protein, 13 aa, Homo sapiens
ASSLGTSGSYEQY

SEQ ID NO: 2421 - protein, 10 aa, Homo sapiens
ASSQGQETQY

SEQ ID NO: 2422 - protein, 12 aa, Homo sapiens
ASSYSGGNQPQH

SEQ ID NO: 2423 - protein, 11 aa, Homo sapiens
ASRRQGNTEAF

SEQ ID NO: 2424 - protein, 11 aa, Homo sapiens
ASSLQGPYEQY

SEQ ID NO: 2425 - protein, 10 aa, Homo sapiens
ASSPRDTEAF

SEQ ID NO: 2426 - protein, 10 aa, Homo sapiens
ASSSITDTQY

SEQ ID NO: 2427 - protein, 12 aa, Homo sapiens
ASSLRQGGTEAF

SEQ ID NO: 2428 - protein, 12 aa, Homo sapiens
ASSLDRGNSPLH

SEQ ID NO: 2429 - protein, 11 aa, Homo sapiens
ASSQGQGYGYT

SEQ ID NO: 2430 - protein, 12 aa, Homo sapiens
ASSPRGSTDTQY

SEQ ID NO: 2431 - protein, 10 aa, Homo sapiens
ASSTGSYEQY

SEQ ID NO: 2432 - protein, 11 aa, Homo sapiens
ASSEGLNTEAF

SEQ ID NO: 2433 - protein, 11 aa, Homo sapiens
ASSPRSSYEQY

SEQ ID NO: 2434 - protein, 11 aa, Homo sapiens
ASSRGSGNTIY

SEQ ID NO: 2435 - protein, 10 aa, Homo sapiens
ASSSDSYGYT

SEQ ID NO: 2436 - protein, 12 aa, Homo sapiens
ASSLAGGRETQY

SEQ ID NO: 2437 - protein, 10 aa, Homo sapiens
ASSQVGNEQF

SEQ ID NO: 2438 - protein, 11 aa, Homo sapiens
ASSPGRSYEQY

SEQ ID NO: 2439 - protein, 11 aa, Homo sapiens
ASSLAGSTEAF

SEQ ID NO: 2440 - protein, 11 aa, Homo sapiens
ASSLQGDYGYT

SEQ ID NO: 2441 - protein, 11 aa, Homo sapiens
ASSLGRGETQY

SEQ ID NO: 2442 - protein, 13 aa, Homo sapiens
ASSLLAGGPDTQY

SEQ ID NO: 2443 - protein, 12 aa, Homo sapiens
ASSYSGSSYEQY

SEQ ID NO: 2444 - protein, 11 aa, Homo sapiens
ASSLGGNSPLH

SEQ ID NO: 2445 - protein, 11 aa, Homo sapiens
ASSPGRQETQY

SEQ ID NO: 2446 - protein, 12 aa, Homo sapiens
ASSPGLGTDTQY

SEQ ID NO: 2447 - protein, 11 aa, Homo sapiens
ASSFGSQETQY

SEQ ID NO: 2448 - protein, 8 aa, Homo sapiens
ASSLDTQY

SEQ ID NO: 2449 - protein, 11 aa, Homo sapiens
ASSPPGGTEAF

SEQ ID NO: 2450 - protein, 9 aa, Homo sapiens
ASSQSDTQY

SEQ ID NO: 2451 - protein, 9 aa, Homo sapiens
ASSPAETQY

SEQ ID NO: 2452 - protein, 9 aa, Homo sapiens
ASSEEETQY

SEQ ID NO: 2453 - protein, 10 aa, Homo sapiens
ASSSPYNEQF

SEQ ID NO: 2454 - protein, 11 aa, Homo sapiens
ASSLQGTYEQY

SEQ ID NO: 2455 - protein, 11 aa, Homo sapiens
ASSSTGTDTQY

SEQ ID NO: 2456 - protein, 10 aa, Homo sapiens
ASSAGTDTQY

SEQ ID NO: 2457 - protein, 10 aa, Homo sapiens
ASSSYTGELF

SEQ ID NO: 2458 - protein, 9 aa, Homo sapiens
ASSLSGEQF

SEQ ID NO: 2459 - protein, 12 aa, Homo sapiens
ASSLGPMNTEAF

SEQ ID NO: 2460 - protein, 10 aa, Homo sapiens
SASGSTDTQY

SEQ ID NO: 2461 - protein, 11 aa, Homo sapiens
ASSLAATDTQY

SEQ ID NO: 2462 - protein, 11 aa, Homo sapiens
ASSPTGYNEQF

SEQ ID NO: 2463 - protein, 9 aa, Homo sapiens
ASSFSTEAF

SEQ ID NO: 2464 - protein, 10 aa, Homo sapiens
ASSRQGTEAF

SEQ ID NO: 2465 - protein, 10 aa, Homo sapiens
ASSLGGPEAF

SEQ ID NO: 2466 - protein, 11 aa, Homo sapiens
ASRDRGTDTQY

SEQ ID NO: 2467 - protein, 11 aa, Homo sapiens
ASSLADSYEQY

SEQ ID NO: 2468 - protein, 11 aa, Homo sapiens
ASSLGTDYEQY

SEQ ID NO: 2469 - protein, 10 aa, Homo sapiens
ASSPITDTQY

SEQ ID NO: 2470 - protein, 13 aa, Homo sapiens
ASSLGQGSTDTQY

SEQ ID NO: 2471 - protein, 12 aa, Homo sapiens
ASSSSGSSYEQY

SEQ ID NO: 2472 - protein, 11 aa, Homo sapiens
ASSLGTAYGYT

SEQ ID NO: 2473 - protein, 12 aa, Homo sapiens
ASSLLSSYNEQF

SEQ ID NO: 2474 - protein, 9 aa, Homo sapiens
ASSPHNEQF

SEQ ID NO: 2475 - protein, 12 aa, Homo sapiens
ASSLARGTDTQY

SEQ ID NO: 2476 - protein, 12 aa, Homo sapiens
ASSLGDSTDTQY

SEQ ID NO: 2477 - protein, 12 aa, Homo sapiens
ASSLEGSSYEQY

SEQ ID NO: 2478 - protein, 11 aa, Homo sapiens
ASSVGGTDTQY

SEQ ID NO: 2479 - protein, 12 aa, Homo sapiens
ASSPGTENTEAF

SEQ ID NO: 2480 - protein, 11 aa, Homo sapiens
ASSLVRTDTQY

SEQ ID NO: 2481 - protein, 10 aa, Homo sapiens
ASSYSGNEQF

SEQ ID NO: 2482 - protein, 12 aa, Homo sapiens
ASSFGGGNQPQH

SEQ ID NO: 2483 - protein, 11 aa, Homo sapiens
ASSQGRNQPQH

SEQ ID NO: 2484 - protein, 10 aa, Homo sapiens
ASSPGLYEQY

SEQ ID NO: 2485 - protein, 12 aa, Homo sapiens
ASSRTGGSYEQY

SEQ ID NO: 2486 - protein, 10 aa, Homo sapiens
ASSLGATEAF

SEQ ID NO: 2487 - protein, 11 aa, Homo sapiens
ASSLSSNTEAF

SEQ ID NO: 2488 - protein, 11 aa, Homo sapiens
ASSPGYQETQY

SEQ ID NO: 2489 - protein, 11 aa, Homo sapiens
ASSPGVQETQY

SEQ ID NO: 2490 - protein, 11 aa, Homo sapiens
ASSLGAGTEAF

SEQ ID NO: 2491 - protein, 11 aa, Homo sapiens
ASSGGSYNEQF

SEQ ID NO: 2492 - protein, 10 aa, Homo sapiens
ASSLSNSPLH

SEQ ID NO: 2493 - protein, 12 aa, Homo sapiens
ASSLGGTNTEAF

SEQ ID NO: 2494 - protein, 10 aa, Homo sapiens
ASSLSTYEQY

SEQ ID NO: 2495 - protein, 10 aa, Homo sapiens
ASSRRNTEAF

SEQ ID NO: 2496 - protein, 9 aa, Homo sapiens
ASSTGETQY

SEQ ID NO: 2497 - protein, 12 aa, Homo sapiens
ASSLAGTSYEQY

SEQ ID NO: 2498 - protein, 12 aa, Homo sapiens
ASSPGQTNTEAF

SEQ ID NO: 2499 - protein, 11 aa, Homo sapiens
ASSGGGNQPQH

SEQ ID NO: 2500 - protein, 11 aa, Homo sapiens
ASSYTGNTEAF

SEQ ID NO: 2501 - protein, 12 aa, Homo sapiens
ASSPSSGANVLT

SEQ ID NO: 2502 - protein, 12 aa, Homo sapiens
ASSLTGAGNTIY

SEQ ID NO: 2503 - protein, 11 aa, Homo sapiens
ASSYGQGYEQY

SEQ ID NO: 2504 - protein, 9 aa, Homo sapiens
ASSGGETQY

SEQ ID NO: 2505 - protein, 11 aa, Homo sapiens
ASSQVLNTEAF

SEQ ID NO: 2506 - protein, 11 aa, Homo sapiens
ASSLSGPYEQY

SEQ ID NO: 2507 - protein, 10 aa, Homo sapiens
ASSQGTYEQY

SEQ ID NO: 2508 - protein, 10 aa, Homo sapiens
ASSRNTDTQY

SEQ ID NO: 2509 - protein, 11 aa, Homo sapiens
ASSLTGSYGYT

SEQ ID NO: 2510 - protein, 11 aa, Homo sapiens
ASSQGLNQPQH

SEQ ID NO: 2511 - protein, 11 aa, Homo sapiens
ASSQGGSYEQY

SEQ ID NO: 2512 - protein, 11 aa, Homo sapiens
ASSYGGGTEAF

SEQ ID NO: 2513 - protein, 12 aa, Homo sapiens
ASSPDRGSYEQY

SEQ ID NO: 2514 - protein, 11 aa, Homo sapiens
ASSSGTGYEQY

SEQ ID NO: 2515 - protein, 12 aa, Homo sapiens
ASSLDRSNQPQH

SEQ ID NO: 2516 - protein, 10 aa, Homo sapiens
ASSLVAYEQY

SEQ ID NO: 2517 - protein, 8 aa, Homo sapiens
SARRETQY

SEQ ID NO: 2518 - protein, 10 aa, Homo sapiens
ASSSRGNEQF

SEQ ID NO: 2519 - protein, 12 aa, Homo sapiens
ASSLEGMNTEAF

SEQ ID NO: 2520 - protein, 11 aa, Homo sapiens
ASSQQGNQPQH

SEQ ID NO: 2521 - protein, 11 aa, Homo sapiens
ASSLGQLYEQY

SEQ ID NO: 2522 - protein, 12 aa, Homo sapiens
ASSPGGLNTEAF

SEQ ID NO: 2523 - protein, 11 aa, Homo sapiens
ASSPGPTDTQY

SEQ ID NO: 2524 - protein, 9 aa, Homo sapiens
ASSLIDTQY

SEQ ID NO: 2525 - protein, 9 aa, Homo sapiens
ASSHYNEQF

SEQ ID NO: 2526 - protein, 12 aa, Homo sapiens
ASSSGTGPYEQY

SEQ ID NO: 2527 - protein, 10 aa, Homo sapiens
ASSRDTGELF

SEQ ID NO: 2528 - protein, 10 aa, Homo sapiens
ASSLALETQY

SEQ ID NO: 2529 - protein, 11 aa, Homo sapiens
ASSPGGADTQY

SEQ ID NO: 2530 - protein, 11 aa, Homo sapiens
ASSLGTGTEAF

SEQ ID NO: 2531 - protein, 11 aa, Homo sapiens
ASRDRGNTEAF

SEQ ID NO: 2532 - protein, 12 aa, Homo sapiens
ASSLGHLNTEAF

SEQ ID NO: 2533 - protein, 12 aa, Homo sapiens
ASSGTGGTDTQY

SEQ ID NO: 2534 - protein, 9 aa, Homo sapiens
ASSWGETQY

SEQ ID NO: 2535 - protein, 11 aa, Homo sapiens
ASSLAGYTEAF

SEQ ID NO: 2536 - protein, 12 aa, Homo sapiens
ASSLTGRNTEAF

SEQ ID NO: 2537 - protein, 13 aa, Homo sapiens
ASSLGTGSNQPQH

SEQ ID NO: 2538 - protein, 10 aa, Homo sapiens
ASSPSADTQY

SEQ ID NO: 2539 - protein, 10 aa, Homo sapiens
ASRASTDTQY

SEQ ID NO: 2540 - protein, 9 aa, Homo sapiens
ASSLNSPLH

SEQ ID NO: 2541 - protein, 10 aa, Homo sapiens
ASSLGGDEQY

SEQ ID NO: 2542 - protein, 13 aa, Homo sapiens
ASSLGLADYNEQF

SEQ ID NO: 2543 - protein, 10 aa, Homo sapiens
ASSDRNTEAF

SEQ ID NO: 2544 - protein, 11 aa, Homo sapiens
ASSRGVNTEAF

SEQ ID NO: 2545 - protein, 10 aa, Homo sapiens
ASSQLNTEAF

SEQ ID NO: 2546 - protein, 11 aa, Homo sapiens
ASSLASQETQY

SEQ ID NO: 2547 - protein, 10 aa, Homo sapiens
ASSFGGNTIY

SEQ ID NO: 2548 - protein, 10 aa, Homo sapiens
ASSLTGDEQY

SEQ ID NO: 2549 - protein, 10 aa, Homo sapiens
ASRDRGYEQY

SEQ ID NO: 2550 - protein, 11 aa, Homo sapiens
ASSLPGGTEAF

SEQ ID NO: 2551 - protein, 12 aa, Homo sapiens
ASSPQGGNTEAF

SEQ ID NO: 2552 - protein, 13 aa, Homo sapiens
ASSLGTGGTDTQY

SEQ ID NO: 2553 - protein, 11 aa, Homo sapiens
ASSGQPNTEAF

SEQ ID NO: 2554 - protein, 10 aa, Homo sapiens
ASSSGQETQY

SEQ ID NO: 2555 - protein, 9 aa, Homo sapiens
ASSLDQPQH

SEQ ID NO: 2556 - protein, 9 aa, Homo sapiens
ASSGGYGYT

SEQ ID NO: 2557 - protein, 10 aa, Homo sapiens
ASSPSGNEQF

SEQ ID NO: 2558 - protein, 11 aa, Homo sapiens
ASSRGPNTEAF

SEQ ID NO: 2559 - protein, 12 aa, Homo sapiens
ASSLRQSTDTQY

SEQ ID NO: 2560 - protein, 12 aa, Homo sapiens
ASSLGQGYTEAF

SEQ ID NO: 2561 - protein, 12 aa, Homo sapiens
ASSRDRGQETQY

SEQ ID NO: 2562 - protein, 11 aa, Homo sapiens
ASSYGVNTEAF

SEQ ID NO: 2563 - protein, 9 aa, Homo sapiens
ASSANTEAF

SEQ ID NO: 2564 - protein, 11 aa, Homo sapiens
ASRRDSTDTQY

SEQ ID NO: 2565 - protein, 9 aa, Homo sapiens
ASSISYEQY

SEQ ID NO: 2566 - protein, 11 aa, Homo sapiens
ASSLGQDTEAF

SEQ ID NO: 2567 - protein, 11 aa, Homo sapiens
ASSRGSSYEQY

SEQ ID NO: 2568 - protein, 10 aa, Homo sapiens
ASSLGLETQY

SEQ ID NO: 2569 - protein, 11 aa, Homo sapiens
ASSLRGPYEQY

SEQ ID NO: 2570 - protein, 10 aa, Homo sapiens
ASSSQGTEAF

SEQ ID NO: 2571 - protein, 10 aa, Homo sapiens
ASSLDGQPQH

SEQ ID NO: 2572 - protein, 11 aa, Homo sapiens
ASSSGGQETQY

SEQ ID NO: 2573 - protein, 11 aa, Homo sapiens
ASSPGTVYGYT

SEQ ID NO: 2574 - protein, 9 aa, Homo sapiens
ASSTTYEQY

SEQ ID NO: 2575 - protein, 12 aa, Homo sapiens
ASSLGRGSYEQY

SEQ ID NO: 2576 - protein, 12 aa, Homo sapiens
ASSSGGGTDTQY

SEQ ID NO: 2577 - protein, 10 aa, Homo sapiens
ASSRTNTEAF

SEQ ID NO: 2578 - protein, 9 aa, Homo sapiens
SARGNTEAF

SEQ ID NO: 2579 - protein, 10 aa, Homo sapiens
ASSQAGYEQY

SEQ ID NO: 2580 - protein, 13 aa, Homo sapiens
ASSLGLAGNNEQF

SEQ ID NO: 2581 - protein, 10 aa, Homo sapiens
ASSWGGTEAF

SEQ ID NO: 2582 - protein, 11 aa, Homo sapiens
ASSLGANQPQH

SEQ ID NO: 2583 - protein, 12 aa, Homo sapiens
ASSPGATNEKLF

SEQ ID NO: 2584 - protein, 10 aa, Homo sapiens
ASSLSAYEQY

SEQ ID NO: 2585 - protein, 9 aa, Homo sapiens
ASSPHYEQY

SEQ ID NO: 2586 - protein, 11 aa, Homo sapiens
ASSPSGNQPQH

SEQ ID NO: 2587 - protein, 11 aa, Homo sapiens
ASSLKGGTEAF

SEQ ID NO: 2588 - protein, 13 aa, Homo sapiens
ASSPSGGSYNEQF

SEQ ID NO: 2589 - protein, 11 aa, Homo sapiens
ASSPTRNTEAF

SEQ ID NO: 2590 - protein, 12 aa, Homo sapiens
ASSPRGGNTEAF

SEQ ID NO: 2591 - protein, 10 aa, Homo sapiens
ASSPGYTEAF

SEQ ID NO: 2592 - protein, 12 aa, Homo sapiens
ASSRTDSNQPQH

SEQ ID NO: 2593 - protein, 11 aa, Homo sapiens
ASSPQENTEAF

SEQ ID NO: 2594 - protein, 10 aa, Homo sapiens
ASSFLGTEAF

SEQ ID NO: 2595 - protein, 12 aa, Homo sapiens
ASSPRDSNQPQH

SEQ ID NO: 2596 - protein, 10 aa, Homo sapiens
ASSQYQETQY

SEQ ID NO: 2597 - protein, 11 aa, Homo sapiens
ASSLDWNTEAF

SEQ ID NO: 2598 - protein, 13 aa, Homo sapiens
ASSLGGTSTDTQY

SEQ ID NO: 2599 - protein, 11 aa, Homo sapiens
ASSLGLAETQY

SEQ ID NO: 2600 - protein, 11 aa, Homo sapiens
ASSLNGNTEAF

SEQ ID NO: 2601 - protein, 10 aa, Homo sapiens
ASSLDNSPLH

SEQ ID NO: 2602 - protein, 13 aa, Homo sapiens
ASSPRGSSYNEQF

SEQ ID NO: 2603 - protein, 10 aa, Homo sapiens
ASSLVRDTQY

SEQ ID NO: 2604 - protein, 12 aa, Homo sapiens
ASSLVQGNTEAF

SEQ ID NO: 2605 - protein, 10 aa, Homo sapiens
ASSPSNTEAF

SEQ ID NO: 2606 - protein, 11 aa, Homo sapiens
SARTSGSYEQY

SEQ ID NO: 2607 - protein, 10 aa, Homo sapiens
ASSLWNTEAF

SEQ ID NO: 2608 - protein, 12 aa, Homo sapiens
ASSLAGVYNEQF

SEQ ID NO: 2609 - protein, 10 aa, Homo sapiens
ASSYGGNEQF

SEQ ID NO: 2610 - protein, 12 aa, Homo sapiens
ASSSTGGSYEQY

SEQ ID NO: 2611 - protein, 10 aa, Homo sapiens
ASSLTGGEQY

SEQ ID NO: 2612 - protein, 12 aa, Homo sapiens
ASSLGSGTDTQY

SEQ ID NO: 2613 - protein, 11 aa, Homo sapiens
ASSLAGAETQY

SEQ ID NO: 2614 - protein, 12 aa, Homo sapiens
ASSPRGSYNEQF

SEQ ID NO: 2615 - protein, 10 aa, Homo sapiens
SARTGDTEAF

SEQ ID NO: 2616 - protein, 12 aa, Homo sapiens
ASSLESSYNEQF

SEQ ID NO: 2617 - protein, 11 aa, Homo sapiens
ASSRGRNTEAF

SEQ ID NO: 2618 - protein, 13 aa, Homo sapiens
ASSPGLAGADTQY

SEQ ID NO: 2619 - protein, 10 aa, Homo sapiens
ASRTGSYEQY

SEQ ID NO: 2620 - protein, 12 aa, Homo sapiens
ASSYSGGTDTQY

SEQ ID NO: 2621 - protein, 10 aa, Homo sapiens
ASSSVTDTQY

SEQ ID NO: 2622 - protein, 11 aa, Homo sapiens
ASSPLGNTEAF

SEQ ID NO: 2623 - protein, 10 aa, Homo sapiens
ASSFQNTEAF

SEQ ID NO: 2624 - protein, 11 aa, Homo sapiens
ASSPRGYNEQF

SEQ ID NO: 2625 - protein, 12 aa, Homo sapiens
ASSLTASTDTQY

SEQ ID NO: 2626 - protein, 11 aa, Homo sapiens
ASSPPGGYEQY

SEQ ID NO: 2627 - protein, 9 aa, Homo sapiens
ASRANTEAF

SEQ ID NO: 2628 - protein, 12 aa, Homo sapiens
ASSLEGRNTEAF

SEQ ID NO: 2629 - protein, 11 aa, Homo sapiens
ASSFLGNTEAF

SEQ ID NO: 2630 - protein, 11 aa, Homo sapiens
ASSLDPNQPQH

SEQ ID NO: 2631 - protein, 9 aa, Homo sapiens
ASSLGSPLH

SEQ ID NO: 2632 - protein, 12 aa, Homo sapiens
ASSLEGSGNTIY

SEQ ID NO: 2633 - protein, 10 aa, Homo sapiens
ASSYRGETQY

SEQ ID NO: 2634 - protein, 12 aa, Homo sapiens
ASSFSGSYNEQF

SEQ ID NO: 2635 - protein, 11 aa, Homo sapiens
ASSLYSTDTQY

SEQ ID NO: 2636 - protein, 11 aa, Homo sapiens
ASSLGNQETQY

SEQ ID NO: 2637 - protein, 12 aa, Homo sapiens
ASSPGYSNQPQH

SEQ ID NO: 2638 - protein, 12 aa, Homo sapiens
ASSLSSYNSPLH

SEQ ID NO: 2639 - protein, 11 aa, Homo sapiens
ASSLNRDTEAF

SEQ ID NO: 2640 - protein, 11 aa, Homo sapiens
ASSLQGPDTQY

SEQ ID NO: 2641 - protein, 10 aa, Homo sapiens
ASSPNYNEQF

SEQ ID NO: 2642 - protein, 11 aa, Homo sapiens
ASSLDTYNEQF

SEQ ID NO: 2643 - protein, 12 aa, Homo sapiens
ASSRDSSGNTIY

SEQ ID NO: 2644 - protein, 11 aa, Homo sapiens
ASSQGQQETQY

SEQ ID NO: 2645 - protein, 12 aa, Homo sapiens
ASSLGGGPYEQY

SEQ ID NO: 2646 - protein, 11 aa, Homo sapiens
ASSFRRNTEAF

SEQ ID NO: 2647 - protein, 9 aa, Homo sapiens
ASSYRYEQY

SEQ ID NO: 2648 - protein, 10 aa, Homo sapiens
ASSQGDTEAF

SEQ ID NO: 2649 - protein, 12 aa, Homo sapiens
ASSLGRVNTEAF

SEQ ID NO: 2650 - protein, 11 aa, Homo sapiens
ASSLVGDQPQH

SEQ ID NO: 2651 - protein, 11 aa, Homo sapiens
ASSRDRGYGYT

SEQ ID NO: 2652 - protein, 11 aa, Homo sapiens
ASSLGGATEAF

SEQ ID NO: 2653 - protein, 12 aa, Homo sapiens
ASSLGGAQETQY

SEQ ID NO: 2654 - protein, 10 aa, Homo sapiens
ASSLTTYEQY

SEQ ID NO: 2655 - protein, 10 aa, Homo sapiens
ASSQGTGELF

SEQ ID NO: 2656 - protein, 9 aa, Homo sapiens
ASSLLDEQF

SEQ ID NO: 2657 - protein, 11 aa, Homo sapiens
ASSLQGGYGYT

SEQ ID NO: 2658 - protein, 12 aa, Homo sapiens
ASSLGQGGETQY

SEQ ID NO: 2659 - protein, 9 aa, Homo sapiens
ASTRNTEAF

SEQ ID NO: 2660 - protein, 11 aa, Homo sapiens
ASSSGGYNEQF

SEQ ID NO: 2661 - protein, 12 aa, Homo sapiens
ASSLGLAAYEQY

SEQ ID NO: 2662 - protein, 12 aa, Homo sapiens
ASSLGAANTEAF

SEQ ID NO: 2663 - protein, 13 aa, Homo sapiens
ASSLGSSGANVLT

SEQ ID NO: 2664 - protein, 11 aa, Homo sapiens
ASSPGQDYGYT

SEQ ID NO: 2665 - protein, 10 aa, Homo sapiens
ASSQDLETQY

SEQ ID NO: 2666 - protein, 11 aa, Homo sapiens
ASSSRGNQPQH

SEQ ID NO: 2667 - protein, 10 aa, Homo sapiens
ASSYSTGELF

SEQ ID NO: 2668 - protein, 12 aa, Homo sapiens
ASSFSGSNQPQH

SEQ ID NO: 2669 - protein, 10 aa, Homo sapiens
ASSLLTGELF

SEQ ID NO: 2670 - protein, 11 aa, Homo sapiens
ASSLVSNTEAF

SEQ ID NO: 2671 - protein, 9 aa, Homo sapiens
ASSRSDTQY

SEQ ID NO: 2672 - protein, 9 aa, Homo sapiens
ASSLGSEQF

SEQ ID NO: 2673 - protein, 10 aa, Homo sapiens
SARDRDTEAF

SEQ ID NO: 2674 - protein, 11 aa, Homo sapiens
ASSRDRDYGYT

SEQ ID NO: 2675 - protein, 11 aa, Homo sapiens
ASSLAGSDTQY

SEQ ID NO: 2676 - protein, 9 aa, Homo sapiens
ASSGADTQY

SEQ ID NO: 2677 - protein, 13 aa, Homo sapiens
ASSLAGGSNQPQH

SEQ ID NO: 2678 - protein, 10 aa, Homo sapiens
ASSQTTDTQY

SEQ ID NO: 2679 - protein, 12 aa, Homo sapiens
ASSLGQGRTEAF

SEQ ID NO: 2680 - protein, 11 aa, Homo sapiens
ASSPASTDTQY

SEQ ID NO: 2681 - protein, 12 aa, Homo sapiens
ASSPGLAADTQY

SEQ ID NO: 2682 - protein, 9 aa, Homo sapiens
ASSQVETQY

SEQ ID NO: 2683 - protein, 9 aa, Homo sapiens
ASSLPDTQY

SEQ ID NO: 2684 - protein, 10 aa, Homo sapiens
ASSLVEETQY

SEQ ID NO: 2685 - protein, 11 aa, Homo sapiens
ASSPGENTEAF

SEQ ID NO: 2686 - protein, 11 aa, Homo sapiens
ASSTTVNTEAF

SEQ ID NO: 2687 - protein, 11 aa, Homo sapiens
ASSLRGGYEQY

SEQ ID NO: 2688 - protein, 11 aa, Homo sapiens
ASSIGGNTEAF

SEQ ID NO: 2689 - protein, 11 aa, Homo sapiens
ASSLGAGNTIY

SEQ ID NO: 2690 - protein, 11 aa, Homo sapiens
ASRDSSYNEQF

SEQ ID NO: 2691 - protein, 11 aa, Homo sapiens
ASSSGTGYGYT

SEQ ID NO: 2692 - protein, 11 aa, Homo sapiens
ASSGTGGTEAF

SEQ ID NO: 2693 - protein, 11 aa, Homo sapiens
ASSSDRNQPQH

SEQ ID NO: 2694 - protein, 10 aa, Homo sapiens
ASSRQGYGYT

SEQ ID NO: 2695 - protein, 11 aa, Homo sapiens
ASSRNSNQPQH

SEQ ID NO: 2696 - protein, 11 aa, Homo sapiens
ASSLTVNQPQH

SEQ ID NO: 2697 - protein, 11 aa, Homo sapiens
ASRGTGNTEAF

SEQ ID NO: 2698 - protein, 10 aa, Homo sapiens
ASSYLNTEAF

SEQ ID NO: 2699 - protein, 12 aa, Homo sapiens
ASSLLAGSYEQY

SEQ ID NO: 2700 - protein, 11 aa, Homo sapiens
ASSENSNQPQH

SEQ ID NO: 2701 - protein, 11 aa, Homo sapiens
ASSRSGANVLT

SEQ ID NO: 2702 - protein, 10 aa, Homo sapiens
ASSLAGDEQY

SEQ ID NO: 2703 - protein, 10 aa, Homo sapiens
ASSYNTGELF

SEQ ID NO: 2704 - protein, 10 aa, Homo sapiens
ASSFTTDTQY

SEQ ID NO: 2705 - protein, 11 aa, Homo sapiens
ASSLAGVETQY

SEQ ID NO: 2706 - protein, 12 aa, Homo sapiens
ASSSSGSYNEQF

SEQ ID NO: 2707 - protein, 10 aa, Homo sapiens
ASRGGSYEQY

SEQ ID NO: 2708 - protein, 11 aa, Homo sapiens
ASSLGDTDTQY

SEQ ID NO: 2709 - protein, 11 aa, Homo sapiens
ASSPQGDQPQH

SEQ ID NO: 2710 - protein, 9 aa, Homo sapiens
ASSFGGEQY

SEQ ID NO: 2711 - protein, 11 aa, Homo sapiens
ASSLGQDYEQY

SEQ ID NO: 2712 - protein, 10 aa, Homo sapiens
ASSRRTDTQY

SEQ ID NO: 2713 - protein, 10 aa, Homo sapiens
ASSYRGYEQY

SEQ ID NO: 2714 - protein, 10 aa, Homo sapiens
ASSPPGTEAF

SEQ ID NO: 2715 - protein, 12 aa, Homo sapiens
ASSPGRLNTEAF

SEQ ID NO: 2716 - protein, 12 aa, Homo sapiens
ASSLGDSYNEQF

SEQ ID NO: 2717 - protein, 11 aa, Homo sapiens
ASSFRGDTEAF

SEQ ID NO: 2718 - protein, 12 aa, Homo sapiens
ASSLDGMNTEAF

SEQ ID NO: 2719 - protein, 11 aa, Homo sapiens
ASSQGPNQPQH

SEQ ID NO: 2720 - protein, 11 aa, Homo sapiens
ASSRGGSYEQY

SEQ ID NO: 2721 - protein, 13 aa, Homo sapiens
ASSLGLSSYNEQF

SEQ ID NO: 2722 - protein, 12 aa, Homo sapiens
ASSLSGNTGELF

SEQ ID NO: 2723 - protein, 11 aa, Homo sapiens
ASSPSGQETQY

SEQ ID NO: 2724 - protein, 13 aa, Homo sapiens
ASSLGTGSTDTQY

SEQ ID NO: 2725 - protein, 10 aa, Homo sapiens
ASSFVNTEAF

SEQ ID NO: 2726 - protein, 10 aa, Homo sapiens
ASSPTGETQY

SEQ ID NO: 2727 - protein, 9 aa, Homo sapiens
SVGGNTEAF

SEQ ID NO: 2728 - protein, 12 aa, Homo sapiens
ASSLGGTGNTIY

SEQ ID NO: 2729 - protein, 13 aa, Homo sapiens
ASSPGTGGTDTQY

SEQ ID NO: 2730 - protein, 10 aa, Homo sapiens
ASSEGGYEQY

SEQ ID NO: 2731 - protein, 9 aa, Homo sapiens
ASSPRTEAF

SEQ ID NO: 2732 - protein, 11 aa, Homo sapiens
ASSPTGAYEQY

SEQ ID NO: 2733 - protein, 12 aa, Homo sapiens
ASSLGTGYNEQF

SEQ ID NO: 2734 - protein, 10 aa, Homo sapiens
ASSQDRDTQY

SEQ ID NO: 2735 - protein, 11 aa, Homo sapiens
ASSEGRNTEAF

SEQ ID NO: 2736 - protein, 10 aa, Homo sapiens
ASSPPADTQY

SEQ ID NO: 2737 - protein, 12 aa, Homo sapiens
ASSPGTVNQPQH

SEQ ID NO: 2738 - protein, 11 aa, Homo sapiens
ASSLARDTEAF

SEQ ID NO: 2739 - protein, 12 aa, Homo sapiens
ASSSTGGNTEAF

SEQ ID NO: 2740 - protein, 9 aa, Homo sapiens
ASSGGNEQF

SEQ ID NO: 2741 - protein, 11 aa, Homo sapiens
ASSLDGTYEQY

SEQ ID NO: 2742 - protein, 12 aa, Homo sapiens
ASSLGAGNQPQH

SEQ ID NO: 2743 - protein, 10 aa, Homo sapiens
ASSLVSNEQF

SEQ ID NO: 2744 - protein, 13 aa, Homo sapiens
ASSLGLAGQETQY

SEQ ID NO: 2745 - protein, 12 aa, Homo sapiens
ASSLGPGNTEAF

SEQ ID NO: 2746 - protein, 11 aa, Homo sapiens
ASSRTLNTEAF

SEQ ID NO: 2747 - protein, 10 aa, Homo sapiens
ASSQDSYGYT

SEQ ID NO: 2748 - protein, 11 aa, Homo sapiens
ASSLRGGETQY

SEQ ID NO: 2749 - protein, 12 aa, Homo sapiens
ASSSGQGNYGYT

SEQ ID NO: 2750 - protein, 11 aa, Homo sapiens
ASSSSMNTEAF

SEQ ID NO: 2751 - protein, 11 aa, Homo sapiens
ASSLDRDYEQY

SEQ ID NO: 2752 - protein, 12 aa, Homo sapiens
ASSQGQGSYEQY

SEQ ID NO: 2753 - protein, 11 aa, Homo sapiens
ASSGTGDQPQH

SEQ ID NO: 2754 - protein, 10 aa, Homo sapiens
ASSLDSDTQY

SEQ ID NO: 2755 - protein, 10 aa, Homo sapiens
ASSRDTYEQY

SEQ ID NO: 2756 - protein, 11 aa, Homo sapiens
ASSFTGTDTQY

SEQ ID NO: 2757 - protein, 12 aa, Homo sapiens
ASSLDGSSYEQY

SEQ ID NO: 2758 - protein, 9 aa, Homo sapiens
ASRTNTEAF

SEQ ID NO: 2759 - protein, 12 aa, Homo sapiens
ASSRDSSNQPQH

SEQ ID NO: 2760 - protein, 12 aa, Homo sapiens
ASSRLAGTDTQY

SEQ ID NO: 2761 - protein, 11 aa, Homo sapiens
ASSPGTNYGYT

SEQ ID NO: 2762 - protein, 11 aa, Homo sapiens
ASSPTSYNEQF

SEQ ID NO: 2763 - protein, 12 aa, Homo sapiens
ASSRQGSTDTQY

SEQ ID NO: 2764 - protein, 9 aa, Homo sapiens
ASSEADTQY

SEQ ID NO: 2765 - protein, 12 aa, Homo sapiens
ASSLAGTNTEAF

SEQ ID NO: 2766 - protein, 10 aa, Homo sapiens
ASSFRADTQY

SEQ ID NO: 2767 - protein, 8 aa, Homo sapiens
ASSGNEQF

SEQ ID NO: 2768 - protein, 10 aa, Homo sapiens
ASSLAAYEQY

SEQ ID NO: 2769 - protein, 11 aa, Homo sapiens
ASSLQGGETQY

SEQ ID NO: 2770 - protein, 11 aa, Homo sapiens
ASSLSPNQPQH

SEQ ID NO: 2771 - protein, 13 aa, Homo sapiens
ASSRLAGGYNEQF

SEQ ID NO: 2772 - protein, 13 aa, Homo sapiens
ASSPTGGSYNEQF

SEQ ID NO: 2773 - protein, 12 aa, Homo sapiens
ASSPGTVSYEQY

SEQ ID NO: 2774 - protein, 12 aa, Homo sapiens
ASSLASSTDTQY

SEQ ID NO: 2775 - protein, 10 aa, Homo sapiens
ASSPRQETQY

SEQ ID NO: 2776 - protein, 11 aa, Homo sapiens
ASSYQGNTEAF

SEQ ID NO: 2777 - protein, 13 aa, Homo sapiens
ASSPDRSSYNEQF

SEQ ID NO: 2778 - protein, 11 aa, Homo sapiens
ASSPDRAYGYT

SEQ ID NO: 2779 - protein, 11 aa, Homo sapiens
ASSLGLTYEQY

SEQ ID NO: 2780 - protein, 12 aa, Homo sapiens
ASSLGTSYNEQF

SEQ ID NO: 2781 - protein, 11 aa, Homo sapiens
ASSSSSGNTIY

SEQ ID NO: 2782 - protein, 11 aa, Homo sapiens
ASSLERTDTQY

SEQ ID NO: 2783 - protein, 12 aa, Homo sapiens
ASSPRGGTDTQY

SEQ ID NO: 2784 - protein, 12 aa, Homo sapiens
ASSPRTGGYEQY

SEQ ID NO: 2785 - protein, 11 aa, Homo sapiens
ASSFLGTDTQY

SEQ ID NO: 2786 - protein, 11 aa, Homo sapiens
ASSVGVNTEAF

SEQ ID NO: 2787 - protein, 11 aa, Homo sapiens
ASSDRENTEAF

SEQ ID NO: 2788 - protein, 12 aa, Homo sapiens
ASSLDGLNTEAF

SEQ ID NO: 2789 - protein, 12 aa, Homo sapiens
ASSPRDRGYEQY

SEQ ID NO: 2790 - protein, 12 aa, Homo sapiens
ASSFGTGNQPQH

SEQ ID NO: 2791 - protein, 12 aa, Homo sapiens
ASSRTGLNTEAF

SEQ ID NO: 2792 - protein, 11 aa, Homo sapiens
ASSLARQETQY

SEQ ID NO: 2793 - protein, 11 aa, Homo sapiens
ASSLQPNTEAF

SEQ ID NO: 2794 - protein, 13 aa, Homo sapiens
ASSPGQGSNQPQH

SEQ ID NO: 2795 - protein, 9 aa, Homo sapiens
ASRRGTEAF

SEQ ID NO: 2796 - protein, 12 aa, Homo sapiens
ASSPRQGGTEAF

SEQ ID NO: 2797 - protein, 12 aa, Homo sapiens
ASSPGQGDQPQH

SEQ ID NO: 2798 - protein, 11 aa, Homo sapiens
ASSQEGNQPQH

SEQ ID NO: 2799 - protein, 12 aa, Homo sapiens
ASSFGQGSYEQY

SEQ ID NO: 2800 - protein, 12 aa, Homo sapiens
ASSLGQGPDTQY

SEQ ID NO: 2801 - protein, 12 aa, Homo sapiens
ASSFGTSTDTQY

SEQ ID NO: 2802 - protein, 11 aa, Homo sapiens
ASSPGPNYGYT

SEQ ID NO: 2803 - protein, 10 aa, Homo sapiens
ASSPGRYEQY

SEQ ID NO: 2804 - protein, 10 aa, Homo sapiens
ASSLDLYEQY

SEQ ID NO: 2805 - protein, 13 aa, Homo sapiens
ASSLAGGRTDTQY

SEQ ID NO: 2806 - protein, 11 aa, Homo sapiens
ASSEGGTDTQY

SEQ ID NO: 2807 - protein, 9 aa, Homo sapiens
ASSLEGTQY

SEQ ID NO: 2808 - protein, 11 aa, Homo sapiens
ASSSGNTGELF

SEQ ID NO: 2809 - protein, 10 aa, Homo sapiens
ASSLGGDGYT

SEQ ID NO: 2810 - protein, 11 aa, Homo sapiens
ASSFGQSYEQY

SEQ ID NO: 2811 - protein, 10 aa, Homo sapiens
ASSFRGDTQY

SEQ ID NO: 2812 - protein, 11 aa, Homo sapiens
ASSFTGNQPQH

SEQ ID NO: 2813 - protein, 12 aa, Homo sapiens
ASSRTSGQETQY

SEQ ID NO: 2814 - protein, 10 aa, Homo sapiens
ASSLTGDGYT

SEQ ID NO: 2815 - protein, 9 aa, Homo sapiens
ASSLHYEQY

SEQ ID NO: 2816 - protein, 9 aa, Homo sapiens
ASSLGDGYT

SEQ ID NO: 2817 - protein, 10 aa, Homo sapiens
ASRGGNTEAF

SEQ ID NO: 2818 - protein, 9 aa, Homo sapiens
ASSLGREAF

SEQ ID NO: 2819 - protein, 11 aa, Homo sapiens
ASSEDSNQPQH

SEQ ID NO: 2820 - protein, 13 aa, Homo sapiens
ASSLGLAGSYEQY

SEQ ID NO: 2821 - protein, 11 aa, Homo sapiens
ASRTSGSYEQY

SEQ ID NO: 2822 - protein, 12 aa, Homo sapiens
ASSLRASTDTQY

SEQ ID NO: 2823 - protein, 10 aa, Homo sapiens
ASSLDPYEQY

SEQ ID NO: 2824 - protein, 11 aa, Homo sapiens
ASSLERNQPQH

SEQ ID NO: 2825 - protein, 12 aa, Homo sapiens
ASSLVSSYNEQF

SEQ ID NO: 2826 - protein, 11 aa, Homo sapiens
ASSGGLNTEAF

SEQ ID NO: 2827 - protein, 9 aa, Homo sapiens
ASSETYEQY

SEQ ID NO: 2828 - protein, 10 aa, Homo sapiens
SARRGNTEAF

SEQ ID NO: 2829 - protein, 14 aa, Homo sapiens
ASSLGTSGSTDTQY

SEQ ID NO: 2830 - protein, 11 aa, Homo sapiens
ASSLSGEETQY

SEQ ID NO: 2831 - protein, 11 aa, Homo sapiens
ASSSTLNTEAF

SEQ ID NO: 2832 - protein, 11 aa, Homo sapiens
ASSFAGTDTQY

SEQ ID NO: 2833 - protein, 12 aa, Homo sapiens
ASSPTSGQETQY

SEQ ID NO: 2834 - protein, 9 aa, Homo sapiens
ASSLSQPQH

SEQ ID NO: 2835 - protein, 7 aa, Homo sapiens
ASGYEQY

SEQ ID NO: 2836 - protein, 9 aa, Homo sapiens
ASSSGQPQH

SEQ ID NO: 2837 - protein, 13 aa, Homo sapiens
ASSLRGSGANVLT

SEQ ID NO: 2838 - protein, 9 aa, Homo sapiens
ASGSYNEQF

SEQ ID NO: 2839 - protein, 11 aa, Homo sapiens
ASSLPGQETQY

SEQ ID NO: 2840 - protein, 8 aa, Homo sapiens
ASSSNEQF

SEQ ID NO: 2841 - protein, 10 aa, Homo sapiens
ASRGDSYEQY

SEQ ID NO: 2842 - protein, 12 aa, Homo sapiens
ASSLQGTNTEAF

SEQ ID NO: 2843 - protein, 11 aa, Homo sapiens
ASSLTGPDTQY

SEQ ID NO: 2844 - protein, 12 aa, Homo sapiens
ASSLVAGNTEAF

SEQ ID NO: 2845 - protein, 11 aa, Homo sapiens
ASSLQSTDTQY

SEQ ID NO: 2846 - protein, 11 aa, Homo sapiens
ASSLISTDTQY

SEQ ID NO: 2847 - protein, 9 aa, Homo sapiens
ASSYTYEQY

SEQ ID NO: 2848 - protein, 11 aa, Homo sapiens
ASSAGLNTEAF

SEQ ID NO: 2849 - protein, 11 aa, Homo sapiens
ASSATVNTEAF

SEQ ID NO: 2850 - protein, 12 aa, Homo sapiens
ASSLLGGNQPQH

SEQ ID NO: 2851 - protein, 12 aa, Homo sapiens
ASSLGRANTEAF

SEQ ID NO: 2852 - protein, 11 aa, Homo sapiens
ASSFSGGTEAF

SEQ ID NO: 2853 - protein, 12 aa, Homo sapiens
ASSLDRATDTQY

SEQ ID NO: 2854 - protein, 9 aa, Homo sapiens
ASSRGYGYT

SEQ ID NO: 2855 - protein, 9 aa, Homo sapiens
ASSIGDTQY

SEQ ID NO: 2856 - protein, 11 aa, Homo sapiens
ASSLGPGNTIY

SEQ ID NO: 2857 - protein, 11 aa, Homo sapiens
ASSLWGNQPQH

SEQ ID NO: 2858 - protein, 9 aa, Homo sapiens
ASSWGNEQF

SEQ ID NO: 2859 - protein, 12 aa, Homo sapiens
ASSLGGASYEQY

SEQ ID NO: 2860 - protein, 11 aa, Homo sapiens
ASSLTASYEQY

SEQ ID NO: 2861 - protein, 12 aa, Homo sapiens
ASSPSGGYNEQF

SEQ ID NO: 2862 - protein, 10 aa, Homo sapiens
ASSFPGTEAF

SEQ ID NO: 2863 - protein, 12 aa, Homo sapiens
ASSLGANTGELF

SEQ ID NO: 2864 - protein, 12 aa, Homo sapiens
ASSLVAGTDTQY

SEQ ID NO: 2865 - protein, 10 aa, Homo sapiens
ASSRENTEAF

SEQ ID NO: 2866 - protein, 11 aa, Homo sapiens
ASSPTNTGELF

SEQ ID NO: 2867 - protein, 9 aa, Homo sapiens
ASSLTTEAF

SEQ ID NO: 2868 - protein, 12 aa, Homo sapiens
ASSLSGVNTEAF

SEQ ID NO: 2869 - protein, 11 aa, Homo sapiens
ASSPGLTDTQY

SEQ ID NO: 2870 - protein, 11 aa, Homo sapiens
ASSFGQGYGYT

SEQ ID NO: 2871 - protein, 12 aa, Homo sapiens
ASSPRTGGTEAF

SEQ ID NO: 2872 - protein, 11 aa, Homo sapiens
ASSSGPSYEQY

SEQ ID NO: 2873 - protein, 11 aa, Homo sapiens
ASSYSGTDTQY

SEQ ID NO: 2874 - protein, 11 aa, Homo sapiens
ASSSRSTDTQY

SEQ ID NO: 2875 - protein, 11 aa, Homo sapiens
ASSLRGSTEAF

SEQ ID NO: 2876 - protein, 11 aa, Homo sapiens
ASSLTSGYEQY

SEQ ID NO: 2877 - protein, 12 aa, Homo sapiens
ASSLVGGGTEAF

SEQ ID NO: 2878 - protein, 9 aa, Homo sapiens
ASSWGDTQY

SEQ ID NO: 2879 - protein, 11 aa, Homo sapiens
ASSWDSTDTQY

SEQ ID NO: 2880 - protein, 12 aa, Homo sapiens
ASSLSGTYNEQF

SEQ ID NO: 2881 - protein, 11 aa, Homo sapiens
ASSPSVNTEAF

SEQ ID NO: 2882 - protein, 13 aa, Homo sapiens
ASSLGTGSYNEQF

SEQ ID NO: 2883 - protein, 11 aa, Homo sapiens
ASSFGTNTEAF

SEQ ID NO: 2884 - protein, 12 aa, Homo sapiens
ASSSRTGNTEAF

SEQ ID NO: 2885 - protein, 11 aa, Homo sapiens
ASRGDSNQPQH

SEQ ID NO: 2886 - protein, 10 aa, Homo sapiens
ASSQVSYEQY

SEQ ID NO: 2887 - protein, 10 aa, Homo sapiens
ASSGGGTEAF

SEQ ID NO: 2888 - protein, 11 aa, Homo sapiens
ASSLEGSTEAF

SEQ ID NO: 2889 - protein, 11 aa, Homo sapiens
ASSLSGGNEQF

SEQ ID NO: 2890 - protein, 11 aa, Homo sapiens
ASSFQGSYEQY

SEQ ID NO: 2891 - protein, 11 aa, Homo sapiens
ASSLQSNQPQH

SEQ ID NO: 2892 - protein, 12 aa, Homo sapiens
ASSLAGPNTEAF

SEQ ID NO: 2893 - protein, 10 aa, Homo sapiens
ASSLVDQPQH

SEQ ID NO: 2894 - protein, 11 aa, Homo sapiens
ASSSSLNTEAF

SEQ ID NO: 2895 - protein, 12 aa, Homo sapiens
ASSWTSGTDTQY

SEQ ID NO: 2896 - protein, 11 aa, Homo sapiens
ASSSDGNTEAF

SEQ ID NO: 2897 - protein, 11 aa, Homo sapiens
ASSFSMNTEAF

SEQ ID NO: 2898 - protein, 12 aa, Homo sapiens
ASSLDRAGNTIY

SEQ ID NO: 2899 - protein, 12 aa, Homo sapiens
ASSLSSSTDTQY

SEQ ID NO: 2900 - protein, 10 aa, Homo sapiens
ASSLGDSPLH

SEQ ID NO: 2901 - protein, 11 aa, Homo sapiens
ASSFRSNQPQH

SEQ ID NO: 2902 - protein, 11 aa, Homo sapiens
ASSEGGNTEAF

SEQ ID NO: 2903 - protein, 11 aa, Homo sapiens
ASSLERGTEAF

SEQ ID NO: 2904 - protein, 10 aa, Homo sapiens
ASSLSRNEQF

SEQ ID NO: 2905 - protein, 11 aa, Homo sapiens
ASSRQGSTEAF

SEQ ID NO: 2906 - protein, 9 aa, Homo sapiens
ASSFRTEAF

SEQ ID NO: 2907 - protein, 11 aa, Homo sapiens
ASSLFSNQPQH

SEQ ID NO: 2908 - protein, 10 aa, Homo sapiens
ASSPDTGELF

SEQ ID NO: 2909 - protein, 10 aa, Homo sapiens
ASSSRSYEQY

SEQ ID NO: 2910 - protein, 11 aa, Homo sapiens
ASSSTGGYGYT

SEQ ID NO: 2911 - protein, 10 aa, Homo sapiens
SARTGGTEAF

SEQ ID NO: 2912 - protein, 12 aa, Homo sapiens
ASSRDSSTDTQY

SEQ ID NO: 2913 - protein, 12 aa, Homo sapiens
ASSLGQENTEAF

SEQ ID NO: 2914 - protein, 11 aa, Homo sapiens
ASSPGGPYEQY

SEQ ID NO: 2915 - protein, 10 aa, Homo sapiens
ASSPTNTEAF

SEQ ID NO: 2916 - protein, 11 aa, Homo sapiens
ASSLEGGYEQY

SEQ ID NO: 2917 - protein, 13 aa, Homo sapiens
ASSLGGNSNQPQH

SEQ ID NO: 2918 - protein, 9 aa, Homo sapiens
ASRTTDTQY

SEQ ID NO: 2919 - protein, 11 aa, Homo sapiens
ASRSSGANVLT

SEQ ID NO: 2920 - protein, 9 aa, Homo sapiens
ASSFGYGYT

SEQ ID NO: 2921 - protein, 11 aa, Homo sapiens
ASSDRVNTEAF

SEQ ID NO: 2922 - protein, 11 aa, Homo sapiens
ASSPGGGQPQH

SEQ ID NO: 2923 - protein, 9 aa, Homo sapiens
ASSEGQPQH

SEQ ID NO: 2924 - protein, 11 aa, Homo sapiens
ASSWTGGTEAF

SEQ ID NO: 2925 - protein, 11 aa, Homo sapiens
ASSRTGAYEQY

SEQ ID NO: 2926 - protein, 11 aa, Homo sapiens
ASSYSSSYEQY

SEQ ID NO: 2927 - protein, 12 aa, Homo sapiens
ASSPGTGVYEQY

SEQ ID NO: 2928 - protein, 13 aa, Homo sapiens
ASSLGPSSYNEQF

SEQ ID NO: 2929 - protein, 10 aa, Homo sapiens
ASSRGGETQY

SEQ ID NO: 2930 - protein, 9 aa, Homo sapiens
ASSLEGEQY

SEQ ID NO: 2931 - protein, 12 aa, Homo sapiens
ASSLSRGNTEAF

SEQ ID NO: 2932 - protein, 10 aa, Homo sapiens
ASSDRGYGYT

SEQ ID NO: 2933 - protein, 11 aa, Homo sapiens
ASSQGRGTEAF

SEQ ID NO: 2934 - protein, 10 aa, Homo sapiens
SARGGNQPQH

SEQ ID NO: 2935 - protein, 11 aa, Homo sapiens
ASSLGIQETQY

SEQ ID NO: 2936 - protein, 8 aa, Homo sapiens
ASSGDTQY

SEQ ID NO: 2937 - protein, 9 aa, Homo sapiens
ASSLADEQF

SEQ ID NO: 2938 - protein, 10 aa, Homo sapiens
ASRGSSYEQY

SEQ ID NO: 2939 - protein, 12 aa, Homo sapiens
ASSLRQGSYEQY

SEQ ID NO: 2940 - protein, 10 aa, Homo sapiens
ASSLAGDEQF

SEQ ID NO: 2941 - protein, 13 aa, Homo sapiens
ASSGLAGGPDTQY

SEQ ID NO: 2942 - protein, 12 aa, Homo sapiens
ASSFRGSTDTQY

SEQ ID NO: 2943 - protein, 10 aa, Homo sapiens
ASSPDTYEQY

SEQ ID NO: 2944 - protein, 13 aa, Homo sapiens
ASSLAGTSTDTQY

SEQ ID NO: 2945 - protein, 12 aa, Homo sapiens
ASSFRGSGNTIY

SEQ ID NO: 2946 - protein, 9 aa, Homo sapiens
ASSSHNEQF

SEQ ID NO: 2947 - protein, 11 aa, Homo sapiens
ASSLTVSYEQY

SEQ ID NO: 2948 - protein, 8 aa, Homo sapiens
ASRGDTQY

SEQ ID NO: 2949 - protein, 11 aa, Homo sapiens
SARGDSNQPQH

SEQ ID NO: 2950 - protein, 11 aa, Homo sapiens
ASSWTGNQPQH

SEQ ID NO: 2951 - protein, 11 aa, Homo sapiens
ASSLGVNYGYT

SEQ ID NO: 2952 - protein, 10 aa, Homo sapiens
ASSAGGTEAF

SEQ ID NO: 2953 - protein, 8 aa, Homo sapiens
ASRGNEQF

SEQ ID NO: 2954 - protein, 10 aa, Homo sapiens
ASSQGRETQY

SEQ ID NO: 2955 - protein, 10 aa, Homo sapiens
ASSPGDQPQH

SEQ ID NO: 2956 - protein, 12 aa, Homo sapiens
ASSLSRGTDTQY

SEQ ID NO: 2957 - protein, 10 aa, Homo sapiens
ASSEGGTEAF

SEQ ID NO: 2958 - protein, 12 aa, Homo sapiens
ASSSGLATDTQY

SEQ ID NO: 2959 - protein, 11 aa, Homo sapiens
ASSLTGVTEAF

SEQ ID NO: 2960 - protein, 12 aa, Homo sapiens
ASSSPGQGYEQY

SEQ ID NO: 2961 - protein, 11 aa, Homo sapiens
ASSQVGGTEAF

SEQ ID NO: 2962 - protein, 10 aa, Homo sapiens
ASSDGNQPQH

SEQ ID NO: 2963 - protein, 13 aa, Homo sapiens
ASSLVGGSTDTQY

SEQ ID NO: 2964 - protein, 10 aa, Homo sapiens
ASSSGDQPQH

SEQ ID NO: 2965 - protein, 9 aa, Homo sapiens
ASSSRNEQF

SEQ ID NO: 2966 - protein, 9 aa, Homo sapiens
ASRGTGELF

SEQ ID NO: 2967 - protein, 11 aa, Homo sapiens
ASSFDSYNEQF

SEQ ID NO: 2968 - protein, 11 aa, Homo sapiens
ASSGQVNTEAF

SEQ ID NO: 2969 - protein, 9 aa, Homo sapiens
ASSSSNEQF

SEQ ID NO: 2970 - protein, 11 aa, Homo sapiens
ASSFGGYNEQF

SEQ ID NO: 2971 - protein, 12 aa, Homo sapiens
ASSLGGQGYEQY

SEQ ID NO: 2972 - protein, 12 aa, Homo sapiens
ASSLGGYTDTQY

SEQ ID NO: 2973 - protein, 10 aa, Homo sapiens
ASSLPGNTIY

SEQ ID NO: 2974 - protein, 10 aa, Homo sapiens
ASSDSYNEQF

SEQ ID NO: 2975 - protein, 10 aa, Homo sapiens
ASSIGNQPQH

SEQ ID NO: 2976 - protein, 12 aa, Homo sapiens
ASSLGQGATEAF

SEQ ID NO: 2977 - protein, 12 aa, Homo sapiens
ASSPGTGDYEQY

SEQ ID NO: 2978 - protein, 10 aa, Homo sapiens
ASRDSTDTQY

SEQ ID NO: 2979 - protein, 11 aa, Homo sapiens
ASSFGTAYEQY

SEQ ID NO: 2980 - protein, 11 aa, Homo sapiens
ASSPSRNTEAF

SEQ ID NO: 2981 - protein, 12 aa, Homo sapiens
ASSPRDRAYEQY

SEQ ID NO: 2982 - protein, 11 aa, Homo sapiens
ASSLDYTDTQY

SEQ ID NO: 2983 - protein, 12 aa, Homo sapiens
ASSRTGMNTEAF

SEQ ID NO: 2984 - protein, 11 aa, Homo sapiens
ASSPSGGTEAF

SEQ ID NO: 2985 - protein, 11 aa, Homo sapiens
ASSPSGYNEQF

SEQ ID NO: 2986 - protein, 11 aa, Homo sapiens
ASSLGLGETQY

SEQ ID NO: 2987 - protein, 11 aa, Homo sapiens
ASSPDRQETQY

SEQ ID NO: 2988 - protein, 10 aa, Homo sapiens
ASSSRYNEQF

SEQ ID NO: 2989 - protein, 12 aa, Homo sapiens
ASSFRGSNQPQH

SEQ ID NO: 2990 - protein, 11 aa, Homo sapiens
ASSQDRNYGYT

SEQ ID NO: 2991 - protein, 11 aa, Homo sapiens
ASSLALTDTQY

SEQ ID NO: 2992 - protein, 10 aa, Homo sapiens
ASSLREETQY

SEQ ID NO: 2993 - protein, 10 aa, Homo sapiens
ASSPRYNEQF

SEQ ID NO: 2994 - protein, 11 aa, Homo sapiens
ASSQDRSYEQY

SEQ ID NO: 2995 - protein, 10 aa, Homo sapiens
ASSGGYNEQF

SEQ ID NO: 2996 - protein, 11 aa, Homo sapiens
ASSPDMNTEAF

SEQ ID NO: 2997 - protein, 11 aa, Homo sapiens
ASSLTGTGELF

SEQ ID NO: 2998 - protein, 9 aa, Homo sapiens
ASSLIETQY

SEQ ID NO: 2999 - protein, 10 aa, Homo sapiens
ASSFLGQPQH

SEQ ID NO: 3000 - protein, 9 aa, Homo sapiens
ASSSDTEAF

SEQ ID NO: 3001 - protein, 12 aa, Homo sapiens
ASSLARGNTEAF

SEQ ID NO: 3002 - protein, 11 aa, Homo sapiens
ASSTGGNQPQH

SEQ ID NO: 3003 - protein, 10 aa, Homo sapiens
ASSFSTGELF

SEQ ID NO: 3004 - protein, 11 aa, Homo sapiens
ASSQDRYNEQF

SEQ ID NO: 3005 - protein, 10 aa, Homo sapiens
ASSLGANEQF

SEQ ID NO: 3006 - protein, 11 aa, Homo sapiens
ASSPGTVYEQY

SEQ ID NO: 3007 - protein, 11 aa, Homo sapiens
ASSQYSNQPQH

SEQ ID NO: 3008 - protein, 9 aa, Homo sapiens
ASSYRDTQY

SEQ ID NO: 3009 - protein, 9 aa, Homo sapiens
ASRSNTEAF

SEQ ID NO: 3010 - protein, 11 aa, Homo sapiens
ASRQGLNTEAF

SEQ ID NO: 3011 - protein, 12 aa, Homo sapiens
ASSLLAGGYEQY

SEQ ID NO: 3012 - protein, 12 aa, Homo sapiens
ASRTSGSTDTQY

SEQ ID NO: 3013 - protein, 11 aa, Homo sapiens
ASSRQGDQPQH

SEQ ID NO: 3014 - protein, 12 aa, Homo sapiens
ASSLGGTNEKLF

SEQ ID NO: 3015 - protein, 11 aa, Homo sapiens
ASSPQGQETQY

SEQ ID NO: 3016 - protein, 10 aa, Homo sapiens
ASSPTGTEAF

SEQ ID NO: 3017 - protein, 11 aa, Homo sapiens
ASSLGRGQPQH

SEQ ID NO: 3018 - protein, 12 aa, Homo sapiens
ASSLGLMNTEAF

SEQ ID NO: 3019 - protein, 11 aa, Homo sapiens
ASSQAGTDTQY

SEQ ID NO: 3020 - protein, 12 aa, Homo sapiens
ASSLQSSYNEQF

SEQ ID NO: 3021 - protein, 11 aa, Homo sapiens
ASSVTVNTEAF

SEQ ID NO: 3022 - protein, 12 aa, Homo sapiens
ASSLGTAYNEQF

SEQ ID NO: 3023 - protein, 10 aa, Homo sapiens
ASSPGTGELF

SEQ ID NO: 3024 - protein, 9 aa, Homo sapiens
ASSFGEKLF

SEQ ID NO: 3025 - protein, 11 aa, Homo sapiens
ASSLTRTDTQY

SEQ ID NO: 3026 - protein, 12 aa, Homo sapiens
ASSLAGGGYEQY

SEQ ID NO: 3027 - protein, 11 aa, Homo sapiens
ASSLWGTDTQY

SEQ ID NO: 3028 - protein, 12 aa, Homo sapiens
ASSSTGSGNTIY

SEQ ID NO: 3029 - protein, 12 aa, Homo sapiens
ASSYGGSNQPQH

SEQ ID NO: 3030 - protein, 11 aa, Homo sapiens
ASSRDGSYEQY

SEQ ID NO: 3031 - protein, 13 aa, Homo sapiens
ASSLGGGGNQPQH

SEQ ID NO: 3032 - protein, 8 aa, Homo sapiens
ASGTDTQY

SEQ ID NO: 3033 - protein, 12 aa, Homo sapiens
ASSRGQLNTEAF

SEQ ID NO: 3034 - protein, 9 aa, Homo sapiens
ASSQGAEAF

SEQ ID NO: 3035 - protein, 8 aa, Homo sapiens
ASRQETQY

SEQ ID NO: 3036 - protein, 10 aa, Homo sapiens
ASSRPQETQY

SEQ ID NO: 3037 - protein, 12 aa, Homo sapiens
ASSLVRGNTEAF

SEQ ID NO: 3038 - protein, 12 aa, Homo sapiens
ASSGQGSNQPQH

SEQ ID NO: 3039 - protein, 11 aa, Homo sapiens
ASSLTVQETQY

SEQ ID NO: 3040 - protein, 12 aa, Homo sapiens
ASSSQGGNQPQH

SEQ ID NO: 3041 - protein, 12 aa, Homo sapiens
ASSRQGSYNEQF

SEQ ID NO: 3042 - protein, 11 aa, Homo sapiens
ASSSDSSYEQY

SEQ ID NO: 3043 - protein, 10 aa, Homo sapiens
ASSPGRDTQY

SEQ ID NO: 3044 - protein, 11 aa, Homo sapiens
ASSYGSTDTQY

SEQ ID NO: 3045 - protein, 8 aa, Homo sapiens
ASSYNEQF

SEQ ID NO: 3046 - protein, 11 aa, Homo sapiens
ASSQEGGTEAF

SEQ ID NO: 3047 - protein, 12 aa, Homo sapiens
ASSRGQGNQPQH

SEQ ID NO: 3048 - protein, 9 aa, Homo sapiens
ASSLQYEQY

SEQ ID NO: 3049 - protein, 9 aa, Homo sapiens
ASSYLDTQY

SEQ ID NO: 3050 - protein, 11 aa, Homo sapiens
ASSPQGYNEQF

SEQ ID NO: 3051 - protein, 12 aa, Homo sapiens
ASSSGTSGYEQY

SEQ ID NO: 3052 - protein, 10 aa, Homo sapiens
ASSFGGYGYT

SEQ ID NO: 3053 - protein, 12 aa, Homo sapiens
ASSPRGLNTEAF

SEQ ID NO: 3054 - protein, 11 aa, Homo sapiens
ASSGTENTEAF

SEQ ID NO: 3055 - protein, 11 aa, Homo sapiens
ASSQDRGETQY

SEQ ID NO: 3056 - protein, 10 aa, Homo sapiens
ASSQVQETQY

SEQ ID NO: 3057 - protein, 12 aa, Homo sapiens
ASSLGSMNTEAF

SEQ ID NO: 3058 - protein, 10 aa, Homo sapiens
ASSLLRETQY

SEQ ID NO: 3059 - protein, 10 aa, Homo sapiens
ASSLADNEQF

SEQ ID NO: 3060 - protein, 11 aa, Homo sapiens
ASSLQGSYGYT

SEQ ID NO: 3061 - protein, 9 aa, Homo sapiens
ASSLLTEAF

SEQ ID NO: 3062 - protein, 12 aa, Homo sapiens
ASSLAGASYEQY

SEQ ID NO: 3063 - protein, 11 aa, Homo sapiens
ASSPDREETQY

SEQ ID NO: 3064 - protein, 12 aa, Homo sapiens
ASSPGQSSYEQY

SEQ ID NO: 3065 - protein, 9 aa, Homo sapiens
ASSLRGEAF

SEQ ID NO: 3066 - protein, 13 aa, Homo sapiens
ASSLTSGAYNEQF

SEQ ID NO: 3067 - protein, 10 aa, Homo sapiens
ASSLVGDEQF

SEQ ID NO: 3068 - protein, 11 aa, Homo sapiens
ASSFGSGNTIY

SEQ ID NO: 3069 - protein, 12 aa, Homo sapiens
ASSWGQGNTEAF

SEQ ID NO: 3070 - protein, 12 aa, Homo sapiens
ASSPRQGAYEQY

SEQ ID NO: 3071 - protein, 9 aa, Homo sapiens
ASSPYYEQY

SEQ ID NO: 3072 - protein, 12 aa, Homo sapiens
ASSLVASTDTQY

SEQ ID NO: 3073 - protein, 10 aa, Homo sapiens
ASSVGNQPQH

SEQ ID NO: 3074 - protein, 10 aa, Homo sapiens
ASSLNNSPLH

SEQ ID NO: 3075 - protein, 13 aa, Homo sapiens
ASSISGSSYNEQF

SEQ ID NO: 3076 - protein, 13 aa, Homo sapiens
ASSPGTGSNQPQH

SEQ ID NO: 3077 - protein, 13 aa, Homo sapiens
ASSLGLAGTYEQY

SEQ ID NO: 3078 - protein, 11 aa, Homo sapiens
ASSLAVSYEQY

SEQ ID NO: 3079 - protein, 12 aa, Homo sapiens
ASSPRQGTDTQY

SEQ ID NO: 3080 - protein, 10 aa, Homo sapiens
ASSYRGNEQF

SEQ ID NO: 3081 - protein, 10 aa, Homo sapiens
ASSFSGDTQY

SEQ ID NO: 3082 - protein, 11 aa, Homo sapiens
ASSPGRTDTQY

SEQ ID NO: 3083 - protein, 11 aa, Homo sapiens
ASSLDRDNEQF

SEQ ID NO: 3084 - protein, 10 aa, Homo sapiens
ASSPGGNTIY

SEQ ID NO: 3085 - protein, 10 aa, Homo sapiens
ASSENTGELF

SEQ ID NO: 3086 - protein, 12 aa, Homo sapiens
ASSLLAGAYEQY

SEQ ID NO: 3087 - protein, 11 aa, Homo sapiens
ASSSSGSYEQY

SEQ ID NO: 3088 - protein, 10 aa, Homo sapiens
ASSLPGTEAF

SEQ ID NO: 3089 - protein, 11 aa, Homo sapiens
ASSLNSQETQY

SEQ ID NO: 3090 - protein, 12 aa, Homo sapiens
ASSPRGSNQPQH

SEQ ID NO: 3091 - protein, 11 aa, Homo sapiens
ASSLIGNTEAF

SEQ ID NO: 3092 - protein, 11 aa, Homo sapiens
ASSSLSTDTQY

SEQ ID NO: 3093 - protein, 12 aa, Homo sapiens
ASSLRTGQETQY

SEQ ID NO: 3094 - protein, 12 aa, Homo sapiens
ASSQGGSYNEQF

SEQ ID NO: 3095 - protein, 12 aa, Homo sapiens
ASSLGQGGEKLF

SEQ ID NO: 3096 - protein, 10 aa, Homo sapiens
ASRPSTDTQY

SEQ ID NO: 3097 - protein, 10 aa, Homo sapiens
ASSESNQPQH

SEQ ID NO: 3098 - protein, 11 aa, Homo sapiens
ASSPTMNTEAF

SEQ ID NO: 3099 - protein, 11 aa, Homo sapiens
ASSSRVNTEAF

SEQ ID NO: 3100 - protein, 11 aa, Homo sapiens
ASSRTGTYEQY

SEQ ID NO: 3101 - protein, 11 aa, Homo sapiens
ASSEQGNQPQH

SEQ ID NO: 3102 - protein, 10 aa, Homo sapiens
ASSLYSYEQY

SEQ ID NO: 3103 - protein, 12 aa, Homo sapiens
ASSLAGGGNEQF

SEQ ID NO: 3104 - protein, 12 aa, Homo sapiens
ASSLLAGADTQY

SEQ ID NO: 3105 - protein, 12 aa, Homo sapiens
ASSQGTGNQPQH

SEQ ID NO: 3106 - protein, 11 aa, Homo sapiens
ASSETGNTEAF

SEQ ID NO: 3107 - protein, 13 aa, Homo sapiens
ASSPLAGAYNEQF

SEQ ID NO: 3108 - protein, 11 aa, Homo sapiens
ASSEGGNQPQH

SEQ ID NO: 3109 - protein, 10 aa, Homo sapiens
ASSSRGETQY

SEQ ID NO: 3110 - protein, 12 aa, Homo sapiens
ASSYSGGSYEQY

SEQ ID NO: 3111 - protein, 9 aa, Homo sapiens
ASSLENEQF

SEQ ID NO: 3112 - protein, 11 aa, Homo sapiens
ASSFRQNTEAF

SEQ ID NO: 3113 - protein, 11 aa, Homo sapiens
ASSLRGTYEQY

SEQ ID NO: 3114 - protein, 12 aa, Homo sapiens
ASSLAGTTDTQY

SEQ ID NO: 3115 - protein, 12 aa, Homo sapiens
ASSPGTSYNEQF

SEQ ID NO: 3116 - protein, 12 aa, Homo sapiens
ASSLDRNTGELF

SEQ ID NO: 3117 - protein, 11 aa, Homo sapiens
ASSFGGDTEAF

SEQ ID NO: 3118 - protein, 12 aa, Homo sapiens
ASSSGQSTDTQY

SEQ ID NO: 3119 - protein, 10 aa, Homo sapiens
ASSLADQPQH

SEQ ID NO: 3120 - protein, 13 aa, Homo sapiens
ASSLTSGSSYEQY

SEQ ID NO: 3121 - protein, 10 aa, Homo sapiens
ASSLHTDTQY

SEQ ID NO: 3122 - protein, 11 aa, Homo sapiens
ASSQALNTEAF

SEQ ID NO: 3123 - protein, 8 aa, Homo sapiens
ASSFNEQF

SEQ ID NO: 3124 - protein, 13 aa, Homo sapiens
ASSLVAGGYNEQF

SEQ ID NO: 3125 - protein, 11 aa, Homo sapiens
ASSAGQNTEAF

SEQ ID NO: 3126 - protein, 12 aa, Homo sapiens
ASSLGPLNTEAF

SEQ ID NO: 3127 - protein, 11 aa, Homo sapiens
ASSSTGYNEQF

SEQ ID NO: 3128 - protein, 11 aa, Homo sapiens
ASSWGSNQPQH

SEQ ID NO: 3129 - protein, 11 aa, Homo sapiens
ASSLAVTDTQY

SEQ ID NO: 3130 - protein, 12 aa, Homo sapiens
ASSQGQLNTEAF

SEQ ID NO: 3131 - protein, 10 aa, Homo sapiens
ASSQVRETQY

SEQ ID NO: 3132 - protein, 11 aa, Homo sapiens
ASSSGLSYEQY

SEQ ID NO: 3133 - protein, 10 aa, Homo sapiens
ASSPENTEAF

SEQ ID NO: 3134 - protein, 11 aa, Homo sapiens
ASSLDSTYEQY

SEQ ID NO: 3135 - protein, 10 aa, Homo sapiens
ASSSLYNEQF

SEQ ID NO: 3136 - protein, 9 aa, Homo sapiens
ASSPQDTQY

SEQ ID NO: 3137 - protein, 11 aa, Homo sapiens
ASSPGLEETQY

SEQ ID NO: 3138 - protein, 10 aa, Homo sapiens
ASSRQGNEQF

SEQ ID NO: 3139 - protein, 10 aa, Homo sapiens
ASSSPNTEAF

SEQ ID NO: 3140 - protein, 11 aa, Homo sapiens
ASSLGGYQPQH

SEQ ID NO: 3141 - protein, 11 aa, Homo sapiens
ASSLALQETQY

SEQ ID NO: 3142 - protein, 11 aa, Homo sapiens
ASSLSPTDTQY

SEQ ID NO: 3143 - protein, 12 aa, Homo sapiens
ASSPPGGNQPQH

SEQ ID NO: 3144 - protein, 10 aa, Homo sapiens
ASRGSYNEQF

SEQ ID NO: 3145 - protein, 11 aa, Homo sapiens
ASSRDSGNTIY

SEQ ID NO: 3146 - protein, 9 aa, Homo sapiens
ASSDSYGYT

SEQ ID NO: 3147 - protein, 11 aa, Homo sapiens
SASGSSYNEQF

SEQ ID NO: 3148 - protein, 10 aa, Homo sapiens
ASSLINQPQH

SEQ ID NO: 3149 - protein, 13 aa, Homo sapiens
ASSSGGSSYNEQF

SEQ ID NO: 3150 - protein, 10 aa, Homo sapiens
ASSPLSYEQY

SEQ ID NO: 3151 - protein, 11 aa, Homo sapiens
ASSLTDNQPQH

SEQ ID NO: 3152 - protein, 11 aa, Homo sapiens
ASSLGGLETQY

SEQ ID NO: 3153 - protein, 10 aa, Homo sapiens
ASSPVTDTQY

SEQ ID NO: 3154 - protein, 12 aa, Homo sapiens
ASSLGLSNQPQH

SEQ ID NO: 3155 - protein, 8 aa, Homo sapiens
SASRETQY

SEQ ID NO: 3156 - protein, 13 aa, Homo sapiens
ASSPGLAAYNEQF

SEQ ID NO: 3157 - protein, 12 aa, Homo sapiens
ASSRGGSNQPQH

SEQ ID NO: 3158 - protein, 12 aa, Homo sapiens
ASSPRTGTDTQY

SEQ ID NO: 3159 - protein, 11 aa, Homo sapiens
ASSSQGNYGYT

SEQ ID NO: 3160 - protein, 11 aa, Homo sapiens
ASSPRGGETQY

SEQ ID NO: 3161 - protein, 12 aa, Homo sapiens
ASSQGGSTDTQY

SEQ ID NO: 3162 - protein, 12 aa, Homo sapiens
ASSLAGQNTEAF

SEQ ID NO: 3163 - protein, 11 aa, Homo sapiens
ASRDRGNQPQH

SEQ ID NO: 3164 - protein, 11 aa, Homo sapiens
ASSDRLNTEAF

SEQ ID NO: 3165 - protein, 11 aa, Homo sapiens
ASSLDRGDTQY

SEQ ID NO: 3166 - protein, 11 aa, Homo sapiens
ASSLSTNTEAF

SEQ ID NO: 3167 - protein, 11 aa, Homo sapiens
ASSLNRGTEAF

SEQ ID NO: 3168 - protein, 12 aa, Homo sapiens
ASSLGGYQETQY

SEQ ID NO: 3169 - protein, 12 aa, Homo sapiens
ASSLAGAGNTIY

SEQ ID NO: 3170 - protein, 10 aa, Homo sapiens
ASSLRGDEQF

SEQ ID NO: 3171 - protein, 10 aa, Homo sapiens
ASSFGPDTQY

SEQ ID NO: 3172 - protein, 9 aa, Homo sapiens
ASRRDTEAF

SEQ ID NO: 3173 - protein, 10 aa, Homo sapiens
ASSYSQETQY

SEQ ID NO: 3174 - protein, 9 aa, Homo sapiens
ASSMNTEAF

SEQ ID NO: 3175 - protein, 11 aa, Homo sapiens
ASSLAGNNEQF

SEQ ID NO: 3176 - protein, 10 aa, Homo sapiens
ASSFSGETQY

SEQ ID NO: 3177 - protein, 10 aa, Homo sapiens
ASSLGQYEQY

SEQ ID NO: 3178 - protein, 12 aa, Homo sapiens
ASSLGLAKNIQY

SEQ ID NO: 3179 - protein, 9 aa, Homo sapiens
ASSYADTQY

SEQ ID NO: 3180 - protein, 11 aa, Homo sapiens
ASSYSMNTEAF

SEQ ID NO: 3181 - protein, 11 aa, Homo sapiens
ASSSDRAYEQY

SEQ ID NO: 3182 - protein, 11 aa, Homo sapiens
ASSEGSTDTQY

SEQ ID NO: 3183 - protein, 12 aa, Homo sapiens
ASSLVSSTDTQY

SEQ ID NO: 3184 - protein, 11 aa, Homo sapiens
ASSFGTSYEQY

SEQ ID NO: 3185 - protein, 13 aa, Homo sapiens
ASSSSGGSYNEQF

SEQ ID NO: 3186 - protein, 9 aa, Homo sapiens
ASSGPYEQY

SEQ ID NO: 3187 - protein, 12 aa, Homo sapiens
ASSLAGTQETQY

SEQ ID NO: 3188 - protein, 9 aa, Homo sapiens
ASSHGETQY

SEQ ID NO: 3189 - protein, 9 aa, Homo sapiens
ASSPRDEQF

SEQ ID NO: 3190 - protein, 10 aa, Homo sapiens
ASSLDRTEAF

SEQ ID NO: 3191 - protein, 12 aa, Homo sapiens
ASSSGGSGNTIY

SEQ ID NO: 3192 - protein, 11 aa, Homo sapiens
ASSQVGTDTQY

SEQ ID NO: 3193 - protein, 11 aa, Homo sapiens
ASRLAGGNEQF

SEQ ID NO: 3194 - protein, 10 aa, Homo sapiens
ASSSQNTEAF

SEQ ID NO: 3195 - protein, 12 aa, Homo sapiens
ASSLGTAGNTIY

SEQ ID NO: 3196 - protein, 11 aa, Homo sapiens
ASSLVSQETQY

SEQ ID NO: 3197 - protein, 10 aa, Homo sapiens
ASSLYNQPQH

SEQ ID NO: 3198 - protein, 11 aa, Homo sapiens
ASSRDFTDTQY

SEQ ID NO: 3199 - protein, 11 aa, Homo sapiens
ASSLAGVYEQY

SEQ ID NO: 3200 - protein, 11 aa, Homo sapiens
ASSGDRNTEAF

SEQ ID NO: 3201 - protein, 11 aa, Homo sapiens
ASSYRGGTEAF

SEQ ID NO: 3202 - protein, 12 aa, Homo sapiens
ASSLGLADNEQF

SEQ ID NO: 3203 - protein, 11 aa, Homo sapiens
ASSLTTNTEAF

SEQ ID NO: 3204 - protein, 11 aa, Homo sapiens
ASSPGQNYEQY

SEQ ID NO: 3205 - protein, 13 aa, Homo sapiens
ASSLGQGNTGELF

SEQ ID NO: 3206 - protein, 12 aa, Homo sapiens
ASSPGLAQETQY

SEQ ID NO: 3207 - protein, 12 aa, Homo sapiens
ASSLDPSTDTQY

SEQ ID NO: 3208 - protein, 9 aa, Homo sapiens
ASSTAYEQY

SEQ ID NO: 3209 - protein, 11 aa, Homo sapiens
ASSLAAYNEQF

SEQ ID NO: 3210 - protein, 12 aa, Homo sapiens
ASSLTGGDTEAF

SEQ ID NO: 3211 - protein, 11 aa, Homo sapiens
ASSLGTVYEQY

SEQ ID NO: 3212 - protein, 12 aa, Homo sapiens
ASSGLAGYNEQF

SEQ ID NO: 3213 - protein, 11 aa, Homo sapiens
ASSLGRDYGYT

SEQ ID NO: 3214 - protein, 11 aa, Homo sapiens
ASSRQGGQPQH

SEQ ID NO: 3215 - protein, 11 aa, Homo sapiens
ASSWDRGYEQY

SEQ ID NO: 3216 - protein, 13 aa, Homo sapiens
ASSRSGSSYNEQF

SEQ ID NO: 3217 - protein, 11 aa, Homo sapiens
ASSRGPQETQY

SEQ ID NO: 3218 - protein, 10 aa, Homo sapiens
ASSYGNQPQH

SEQ ID NO: 3219 - protein, 10 aa, Homo sapiens
ASSLTNYGYT

SEQ ID NO: 3220 - protein, 11 aa, Homo sapiens
ASSFTANTEAF

SEQ ID NO: 3221 - protein, 9 aa, Homo sapiens
ASSRGNTIY

SEQ ID NO: 3222 - protein, 13 aa, Homo sapiens
ASSPLAGSYNEQF

SEQ ID NO: 3223 - protein, 12 aa, Homo sapiens
ASSLGQGVYEQY

SEQ ID NO: 3224 - protein, 12 aa, Homo sapiens
ASSPGGGNTEAF

SEQ ID NO: 3225 - protein, 11 aa, Homo sapiens
ASSPQLNTEAF

SEQ ID NO: 3226 - protein, 10 aa, Homo sapiens
ASSTRTDTQY

SEQ ID NO: 3227 - protein, 12 aa, Homo sapiens
ASSSGQPNTEAF

SEQ ID NO: 3228 - protein, 11 aa, Homo sapiens
ASSLGHSYEQY

SEQ ID NO: 3229 - protein, 12 aa, Homo sapiens
ASSSTSGSYEQY

SEQ ID NO: 3230 - protein, 12 aa, Homo sapiens
ASSFGTGAYEQY

SEQ ID NO: 3231 - protein, 10 aa, Homo sapiens
ASSGLNTEAF

SEQ ID NO: 3232 - protein, 11 aa, Homo sapiens
ASSLDRATEAF

SEQ ID NO: 3233 - protein, 11 aa, Homo sapiens
ASSPGSNTEAF

SEQ ID NO: 3234 - protein, 10 aa, Homo sapiens
ASSLADTEAF

SEQ ID NO: 3235 - protein, 13 aa, Homo sapiens
ASSLGLAGAYEQY

SEQ ID NO: 3236 - protein, 11 aa, Homo sapiens
ASSLVPTDTQY

SEQ ID NO: 3237 - protein, 10 aa, Homo sapiens
ASSTGGYEQY

SEQ ID NO: 3238 - protein, 11 aa, Homo sapiens
ASSRTANYGYT

SEQ ID NO: 3239 - protein, 9 aa, Homo sapiens
ASSRNYGYT

SEQ ID NO: 3240 - protein, 12 aa, Homo sapiens
ASSPGTGDQPQH

SEQ ID NO: 3241 - protein, 11 aa, Homo sapiens
ASSLGQGQPQH

SEQ ID NO: 3242 - protein, 12 aa, Homo sapiens
ASSPGTANQPQH

SEQ ID NO: 3243 - protein, 8 aa, Homo sapiens
ASSRNEQF

SEQ ID NO: 3244 - protein, 9 aa, Homo sapiens
ASSIRETQY

SEQ ID NO: 3245 - protein, 12 aa, Homo sapiens
ASSLRQGAYEQY

SEQ ID NO: 3246 - protein, 12 aa, Homo sapiens
ASSLGGPQETQY

SEQ ID NO: 3247 - protein, 11 aa, Homo sapiens
ASSLSSQETQY

SEQ ID NO: 3248 - protein, 11 aa, Homo sapiens
ASSLAGDYEQY

SEQ ID NO: 3249 - protein, 13 aa, Homo sapiens
ASSLTSGTYNEQF

SEQ ID NO: 3250 - protein, 10 aa, Homo sapiens
ASSLRDNEQF

SEQ ID NO: 3251 - protein, 11 aa, Homo sapiens
ASSQEGTDTQY

SEQ ID NO: 3252 - protein, 11 aa, Homo sapiens
ASRTGLNTEAF

SEQ ID NO: 3253 - protein, 11 aa, Homo sapiens
ASSLGFQETQY

SEQ ID NO: 3254 - protein, 12 aa, Homo sapiens
ASSSGQGGTEAF

SEQ ID NO: 3255 - protein, 11 aa, Homo sapiens
ASSLAGDYGYT

SEQ ID NO: 3256 - protein, 11 aa, Homo sapiens
ASSFGQTYEQY

SEQ ID NO: 3257 - protein, 10 aa, Homo sapiens
ASSLIGYEQY

SEQ ID NO: 3258 - protein, 12 aa, Homo sapiens
ASSQGGGTDTQY

SEQ ID NO: 3259 - protein, 10 aa, Homo sapiens
ASSFGNSPLH

SEQ ID NO: 3260 - protein, 12 aa, Homo sapiens
ASSTSGSTDTQY

SEQ ID NO: 3261 - protein, 11 aa, Homo sapiens
ASSYRLNTEAF

SEQ ID NO: 3262 - protein, 11 aa, Homo sapiens
ASSPAGNTEAF

SEQ ID NO: 3263 - protein, 9 aa, Homo sapiens
ASRYTDTQY

SEQ ID NO: 3264 - protein, 11 aa, Homo sapiens
ASSTGMNTEAF

SEQ ID NO: 3265 - protein, 11 aa, Homo sapiens
ASSGTGGYEQY

SEQ ID NO: 3266 - protein, 13 aa, Homo sapiens
ASSLGQGGTDTQY

SEQ ID NO: 3267 - protein, 12 aa, Homo sapiens
ASSYGSSYNEQF

SEQ ID NO: 3268 - protein, 9 aa, Homo sapiens
ASSPTGELF

SEQ ID NO: 3269 - protein, 13 aa, Homo sapiens
ASSSGTSSYNEQF

SEQ ID NO: 3270 - protein, 11 aa, Homo sapiens
ASSGQSNQPQH

SEQ ID NO: 3271 - protein, 11 aa, Homo sapiens
ASSRDYQETQY

SEQ ID NO: 3272 - protein, 12 aa, Homo sapiens
ASSPRTGTYEQY

SEQ ID NO: 3273 - protein, 11 aa, Homo sapiens
ASSLGENQPQH

SEQ ID NO: 3274 - protein, 12 aa, Homo sapiens
ASSFSSGANVLT

SEQ ID NO: 3275 - protein, 10 aa, Homo sapiens
ASSRYTDTQY

SEQ ID NO: 3276 - protein, 11 aa, Homo sapiens
ASSWDSYNEQF

SEQ ID NO: 3277 - protein, 11 aa, Homo sapiens
ASSPGAQETQY

SEQ ID NO: 3278 - protein, 11 aa, Homo sapiens
ASSPGGTYEQY

SEQ ID NO: 3279 - protein, 10 aa, Homo sapiens
ASSLTEETQY

SEQ ID NO: 3280 - protein, 10 aa, Homo sapiens
ASSQGYTEAF

SEQ ID NO: 3281 - protein, 10 aa, Homo sapiens
ASSVGGTEAF

SEQ ID NO: 3282 - protein, 12 aa, Homo sapiens
ASSPGQGGYGYT

SEQ ID NO: 3283 - protein, 11 aa, Homo sapiens
ASSLGGGNTIY

SEQ ID NO: 3284 - protein, 12 aa, Homo sapiens
ASSFGTGNTEAF

SEQ ID NO: 3285 - protein, 12 aa, Homo sapiens
ASSPDSSGNTIY

SEQ ID NO: 3286 - protein, 10 aa, Homo sapiens
ASSLTGQPQH

SEQ ID NO: 3287 - protein, 10 aa, Homo sapiens
ASSPRGQPQH

SEQ ID NO: 3288 - protein, 11 aa, Homo sapiens
ASSPGGGYGYT

SEQ ID NO: 3289 - protein, 10 aa, Homo sapiens
ASSLIQETQY

SEQ ID NO: 3290 - protein, 11 aa, Homo sapiens
ASSWGGNTEAF

SEQ ID NO: 3291 - protein, 12 aa, Homo sapiens
ASSSTGSTDTQY

SEQ ID NO: 3292 - protein, 11 aa, Homo sapiens
ASSLTDSYEQY

SEQ ID NO: 3293 - protein, 12 aa, Homo sapiens
ASSLGGGTYEQY

SEQ ID NO: 3294 - protein, 13 aa, Homo sapiens
ASSLGGGGTDTQY

SEQ ID NO: 3295 - protein, 13 aa, Homo sapiens
ASSSTSGSTDTQY

SEQ ID NO: 3296 - protein, 9 aa, Homo sapiens
ASSLGVEQY

SEQ ID NO: 3297 - protein, 12 aa, Homo sapiens
ASSEAGGTDTQY

SEQ ID NO: 3298 - protein, 13 aa, Homo sapiens
ASSPDRGSYNEQF

SEQ ID NO: 3299 - protein, 11 aa, Homo sapiens
ASSSDLNTEAF

SEQ ID NO: 3300 - protein, 10 aa, Homo sapiens
ASSFSQETQY

SEQ ID NO: 3301 - protein, 11 aa, Homo sapiens
ASSPPGYNEQF

SEQ ID NO: 3302 - protein, 11 aa, Homo sapiens
ASSPGRDQPQH

SEQ ID NO: 3303 - protein, 12 aa, Homo sapiens
ASSLTATNEKLF

SEQ ID NO: 3304 - protein, 9 aa, Homo sapiens
ASSPGGEQF

SEQ ID NO: 3305 - protein, 9 aa, Homo sapiens
ASSLGPEQY

SEQ ID NO: 3306 - protein, 10 aa, Homo sapiens
ASRQGGTEAF

SEQ ID NO: 3307 - protein, 12 aa, Homo sapiens
ASSLGGQNTEAF

SEQ ID NO: 3308 - protein, 11 aa, Homo sapiens
ASSLDRNNEQF

SEQ ID NO: 3309 - protein, 9 aa, Homo sapiens
ASSSNSPLH

SEQ ID NO: 3310 - protein, 9 aa, Homo sapiens
ASSFHNEQF

SEQ ID NO: 3311 - protein, 11 aa, Homo sapiens
ASSLGPGTEAF

SEQ ID NO: 3312 - protein, 11 aa, Homo sapiens
ASSLSYQETQY

SEQ ID NO: 3313 - protein, 12 aa, Homo sapiens
ASSLGGGAYEQY

SEQ ID NO: 3314 - protein, 10 aa, Homo sapiens
SARDRGYEQY

SEQ ID NO: 3315 - protein, 13 aa, Homo sapiens
ASSPGQSSYNEQF

SEQ ID NO: 3316 - protein, 11 aa, Homo sapiens
ASSIQGNQPQH

SEQ ID NO: 3317 - protein, 8 aa, Homo sapiens
ASSNYEQY

SEQ ID NO: 3318 - protein, 12 aa, Homo sapiens
ASSYGTGGYEQY

SEQ ID NO: 3319 - protein, 10 aa, Homo sapiens
ASSLRGNTIY

SEQ ID NO: 3320 - protein, 12 aa, Homo sapiens
ASSLDSGANVLT

SEQ ID NO: 3321 - protein, 10 aa, Homo sapiens
ASSFPGQPQH

SEQ ID NO: 3322 - protein, 12 aa, Homo sapiens
ASSWTSGSYEQY

SEQ ID NO: 3323 - protein, 12 aa, Homo sapiens
ASSRTSGTYEQY

SEQ ID NO: 3324 - protein, 13 aa, Homo sapiens
ASSPLAGSTDTQY

SEQ ID NO: 3325 - protein, 10 aa, Homo sapiens
ASSGTGYEQY

SEQ ID NO: 3326 - protein, 9 aa, Homo sapiens
ASSFRGEQY

SEQ ID NO: 3327 - protein, 11 aa, Homo sapiens
ASSLDLNQPQH

SEQ ID NO: 3328 - protein, 13 aa, Homo sapiens
ASSSPGQGSYEQY

SEQ ID NO: 3329 - protein, 11 aa, Homo sapiens
ASSGQGGQPQH

SEQ ID NO: 3330 - protein, 10 aa, Homo sapiens
AISESTDTQY

SEQ ID NO: 3331 - protein, 11 aa, Homo sapiens
ASSLLGQETQY

SEQ ID NO: 3332 - protein, 10 aa, Homo sapiens
ASSAGNQPQH

SEQ ID NO: 3333 - protein, 12 aa, Homo sapiens
ASSYGGSSYEQY

SEQ ID NO: 3334 - protein, 12 aa, Homo sapiens
ASSLSASTDTQY

SEQ ID NO: 3335 - protein, 11 aa, Homo sapiens
ASSSDRGTEAF

SEQ ID NO: 3336 - protein, 12 aa, Homo sapiens
ASSLTSSTDTQY

SEQ ID NO: 3337 - protein, 13 aa, Homo sapiens
ASSQGLAGTDTQY

SEQ ID NO: 3338 - protein, 11 aa, Homo sapiens
ASRLAGTDTQY

SEQ ID NO: 3339 - protein, 11 aa, Homo sapiens
ASSSDRGYGYT

SEQ ID NO: 3340 - protein, 13 aa, Homo sapiens
ASSDSSGSTDTQY

SEQ ID NO: 3341 - protein, 10 aa, Homo sapiens
ASRQGSYEQY

SEQ ID NO: 3342 - protein, 12 aa, Homo sapiens
ASSLGGANYGYT

SEQ ID NO: 3343 - protein, 10 aa, Homo sapiens
ASSSRGDTQY

SEQ ID NO: 3344 - protein, 14 aa, Homo sapiens
ASSPGLAGSTDTQY

SEQ ID NO: 3345 - protein, 11 aa, Homo sapiens
ASSLTGATEAF

SEQ ID NO: 3346 - protein, 10 aa, Homo sapiens
ASSSNNQPQH

SEQ ID NO: 3347 - protein, 13 aa, Homo sapiens
ASSLASGSTDTQY

SEQ ID NO: 3348 - protein, 13 aa, Homo sapiens
ASSLQGSSYNEQF

SEQ ID NO: 3349 - protein, 11 aa, Homo sapiens
ASSSDRDTEAF

SEQ ID NO: 3350 - protein, 8 aa, Homo sapiens
ASSSETQY

SEQ ID NO: 3351 - protein, 9 aa, Homo sapiens
ASSVTYEQY

SEQ ID NO: 3352 - protein, 11 aa, Homo sapiens
ASSRDFQETQY

SEQ ID NO: 3353 - protein, 11 aa, Homo sapiens
ASSLASNTEAF

SEQ ID NO: 3354 - protein, 11 aa, Homo sapiens
ASSQVRNTEAF

SEQ ID NO: 3355 - protein, 10 aa, Homo sapiens
ASSWDSYEQY

SEQ ID NO: 3356 - protein, 12 aa, Homo sapiens
ASSSTGSSYEQY

SEQ ID NO: 3357 - protein, 13 aa, Homo sapiens
ASSLGGAGANVLT

SEQ ID NO: 3358 - protein, 13 aa, Homo sapiens
ASSIGGSSYNEQF

SEQ ID NO: 3359 - protein, 11 aa, Homo sapiens
ASSLAPNQPQH

SEQ ID NO: 3360 - protein, 13 aa, Homo sapiens
ASSLGGSSTDTQY

SEQ ID NO: 3361 - protein, 10 aa, Homo sapiens
ASSLGSGELF

SEQ ID NO: 3362 - protein, 10 aa, Homo sapiens
ASSRGGNEQF

SEQ ID NO: 3363 - protein, 10 aa, Homo sapiens
ASSQEGETQY

SEQ ID NO: 3364 - protein, 11 aa, Homo sapiens
ASSRDMNTEAF

SEQ ID NO: 3365 - protein, 9 aa, Homo sapiens
ASRLYNEQF

SEQ ID NO: 3366 - protein, 11 aa, Homo sapiens
ASSLGRGYGYT

SEQ ID NO: 3367 - protein, 12 aa, Homo sapiens
ASSLRDRGYEQY

SEQ ID NO: 3368 - protein, 9 aa, Homo sapiens
SARGGTEAF

SEQ ID NO: 3369 - protein, 10 aa, Homo sapiens
ASSLGVETQY

SEQ ID NO: 3370 - protein, 9 aa, Homo sapiens
ASRGDTEAF

SEQ ID NO: 3371 - protein, 12 aa, Homo sapiens
ASSLTGGYNEQF

SEQ ID NO: 3372 - protein, 11 aa, Homo sapiens
ASSLGSGTEAF

SEQ ID NO: 3373 - protein, 10 aa, Homo sapiens
ASSLATYEQY

SEQ ID NO: 3374 - protein, 12 aa, Homo sapiens
ASSPRQGPYEQY

SEQ ID NO: 3375 - protein, 12 aa, Homo sapiens
ASSFGSSGNTIY

SEQ ID NO: 3376 - protein, 9 aa, Homo sapiens
ASSQKETQY

SEQ ID NO: 3377 - protein, 12 aa, Homo sapiens
ASSLSSGTDTQY

SEQ ID NO: 3378 - protein, 11 aa, Homo sapiens
ASSLGQVYEQY

SEQ ID NO: 3379 - protein, 11 aa, Homo sapiens
ASSQGGNYGYT

SEQ ID NO: 3380 - protein, 12 aa, Homo sapiens
ASSLGGAGTEAF

SEQ ID NO: 3381 - protein, 10 aa, Homo sapiens
ASSQVGQPQH

SEQ ID NO: 3382 - protein, 12 aa, Homo sapiens
ASSRDRLNTEAF

SEQ ID NO: 3383 - protein, 11 aa, Homo sapiens
ASSTGGNTEAF

SEQ ID NO: 3384 - protein, 13 aa, Homo sapiens
ASSLGLASTDTQY

SEQ ID NO: 3385 - protein, 11 aa, Homo sapiens
ASSLEVNQPQH

SEQ ID NO: 3386 - protein, 12 aa, Homo sapiens
ASSQGSSYNEQF

SEQ ID NO: 3387 - protein, 13 aa, Homo sapiens
ASSELAGGYNEQF

SEQ ID NO: 3388 - protein, 10 aa, Homo sapiens
ASSSSGDTQY

SEQ ID NO: 3389 - protein, 11 aa, Homo sapiens
ASSYRGSYEQY

SEQ ID NO: 3390 - protein, 12 aa, Homo sapiens
ASSLEGSYNEQF

SEQ ID NO: 3391 - protein, 9 aa, Homo sapiens
ASSPSTEAF

SEQ ID NO: 3392 - protein, 9 aa, Homo sapiens
ASRLQETQY

SEQ ID NO: 3393 - protein, 11 aa, Homo sapiens
ASSSTGDTEAF

SEQ ID NO: 3394 - protein, 9 aa, Homo sapiens
ASGSSYEQY

SEQ ID NO: 3395 - protein, 12 aa, Homo sapiens
ASSGTSGSYEQY

SEQ ID NO: 3396 - protein, 13 aa, Homo sapiens
ASSQGLAGSYEQY

SEQ ID NO: 3397 - protein, 12 aa, Homo sapiens
ASSLGPSNQPQH

SEQ ID NO: 3398 - protein, 12 aa, Homo sapiens
ASSLRTSTDTQY

SEQ ID NO: 3399 - protein, 12 aa, Homo sapiens
ASSLRGRNTEAF

SEQ ID NO: 3400 - protein, 11 aa, Homo sapiens
ASSLKGDTEAF

SEQ ID NO: 3401 - protein, 11 aa, Homo sapiens
ASSFEGNTEAF

SEQ ID NO: 3402 - protein, 11 aa, Homo sapiens
ASSLYGNTEAF

SEQ ID NO: 3403 - protein, 10 aa, Homo sapiens
ASSFSGQPQH

SEQ ID NO: 3404 - protein, 12 aa, Homo sapiens
ASSFLAGTDTQY

SEQ ID NO: 3405 - protein, 11 aa, Homo sapiens
ASSLPGANVLT

SEQ ID NO: 3406 - protein, 13 aa, Homo sapiens
ASSLTGYSNQPQH

SEQ ID NO: 3407 - protein, 11 aa, Homo sapiens
ASSLGQLYGYT

SEQ ID NO: 3408 - protein, 10 aa, Homo sapiens
ASSGDTDTQY

SEQ ID NO: 3409 - protein, 11 aa, Homo sapiens
ASSLGSTYEQY

SEQ ID NO: 3410 - protein, 11 aa, Homo sapiens
ASSLGGKETQY

SEQ ID NO: 3411 - protein, 11 aa, Homo sapiens
ASSLGLEETQY

SEQ ID NO: 3412 - protein, 9 aa, Homo sapiens
ASSSDNEQF

SEQ ID NO: 3413 - protein, 13 aa, Homo sapiens
ASSLVGGSYNEQF

SEQ ID NO: 3414 - protein, 10 aa, Homo sapiens
ASSSNQETQY

SEQ ID NO: 3415 - protein, 12 aa, Homo sapiens
ASSLGQQNTEAF

SEQ ID NO: 3416 - protein, 11 aa, Homo sapiens
ASSQGPQETQY

SEQ ID NO: 3417 - protein, 11 aa, Homo sapiens
ASSLWENTEAF

SEQ ID NO: 3418 - protein, 12 aa, Homo sapiens
ASSLGPGTDTQY

SEQ ID NO: 3419 - protein, 13 aa, Homo sapiens
ASSPRTSGYNEQF

SEQ ID NO: 3420 - protein, 12 aa, Homo sapiens
ASSLTGGADTQY

SEQ ID NO: 3421 - protein, 11 aa, Homo sapiens
ASSVGMNTEAF

SEQ ID NO: 3422 - protein, 10 aa, Homo sapiens
ASSQMNTEAF

SEQ ID NO: 3423 - protein, 12 aa, Homo sapiens
ASSFGTVNTEAF

SEQ ID NO: 3424 - protein, 12 aa, Homo sapiens
ASSLSYSNQPQH

SEQ ID NO: 3425 - protein, 10 aa, Homo sapiens
ASSFLGETQY

SEQ ID NO: 3426 - protein, 11 aa, Homo sapiens
ASSLDGGTEAF

SEQ ID NO: 3427 - protein, 11 aa, Homo sapiens
ASSPGQSYGYT

SEQ ID NO: 3428 - protein, 11 aa, Homo sapiens
ASSLVSGNTIY

SEQ ID NO: 3429 - protein, 9 aa, Homo sapiens
ASTNTDTQY

SEQ ID NO: 3430 - protein, 12 aa, Homo sapiens
ASSLAQGNTEAF

SEQ ID NO: 3431 - protein, 9 aa, Homo sapiens
ASSRRDTQY

SEQ ID NO: 3432 - protein, 12 aa, Homo sapiens
ASSYGGSTDTQY

SEQ ID NO: 3433 - protein, 11 aa, Homo sapiens
ASSTGSNQPQH

SEQ ID NO: 3434 - protein, 9 aa, Homo sapiens
ASRVTDTQY

SEQ ID NO: 3435 - protein, 12 aa, Homo sapiens
ASSLSGGGTEAF

SEQ ID NO: 3436 - protein, 12 aa, Homo sapiens
ASSSGTGTDTQY

SEQ ID NO: 3437 - protein, 10 aa, Homo sapiens
ASSQVGDTQY

SEQ ID NO: 3438 - protein, 11 aa, Homo sapiens
ASSVGPNTEAF

SEQ ID NO: 3439 - protein, 11 aa, Homo sapiens
ASSDSNTGELF

SEQ ID NO: 3440 - protein, 10 aa, Homo sapiens
ASSLSDQPQH

SEQ ID NO: 3441 - protein, 11 aa, Homo sapiens
ASSPGLTYEQY

SEQ ID NO: 3442 - protein, 10 aa, Homo sapiens
ASSLDGTEAF

SEQ ID NO: 3443 - protein, 12 aa, Homo sapiens
ASSQGYSNQPQH

SEQ ID NO: 3444 - protein, 10 aa, Homo sapiens
ASSLGGSEAF

SEQ ID NO: 3445 - protein, 12 aa, Homo sapiens
ASSLGLASYEQY

SEQ ID NO: 3446 - protein, 11 aa, Homo sapiens
ASSYSSGNTIY

SEQ ID NO: 3447 - protein, 10 aa, Homo sapiens
ASRGLNTEAF

SEQ ID NO: 3448 - protein, 10 aa, Homo sapiens
ASSFRDQPQH

SEQ ID NO: 3449 - protein, 10 aa, Homo sapiens
ASSLVSETQY

SEQ ID NO: 3450 - protein, 9 aa, Homo sapiens
ASSPGDEQY

SEQ ID NO: 3451 - protein, 11 aa, Homo sapiens
ASSLAQGYEQY

SEQ ID NO: 3452 - protein, 11 aa, Homo sapiens
ASSLGLGTEAF

SEQ ID NO: 3453 - protein, 12 aa, Homo sapiens
ASSLAGDTDTQY

SEQ ID NO: 3454 - protein, 12 aa, Homo sapiens
ASSRTGNTGELF

SEQ ID NO: 3455 - protein, 11 aa, Homo sapiens
ASSPAGTDTQY

SEQ ID NO: 3456 - protein, 11 aa, Homo sapiens
ASSLRGDYGYT

SEQ ID NO: 3457 - protein, 11 aa, Homo sapiens
ASSQQGGTEAF

SEQ ID NO: 3458 - protein, 12 aa, Homo sapiens
ASSLGGRNQPQH

SEQ ID NO: 3459 - protein, 11 aa, Homo sapiens
ASSLVRDTEAF

SEQ ID NO: 3460 - protein, 10 aa, Homo sapiens
ASSLLDTEAF

SEQ ID NO: 3461 - protein, 11 aa, Homo sapiens
ASSQAGNTEAF

SEQ ID NO: 3462 - protein, 11 aa, Homo sapiens
ASSLGLNYGYT

SEQ ID NO: 3463 - protein, 13 aa, Homo sapiens
ASSWTSGSTDTQY

SEQ ID NO: 3464 - protein, 8 aa, Homo sapiens
ASSLGEQF

SEQ ID NO: 3465 - protein, 10 aa, Homo sapiens
ASSLLRDTQY

SEQ ID NO: 3466 - protein, 12 aa, Homo sapiens
ASSPSGGSYEQY

SEQ ID NO: 3467 - protein, 11 aa, Homo sapiens
ASRGGGTDTQY

SEQ ID NO: 3468 - protein, 12 aa, Homo sapiens
ASSLGPSSYEQY

SEQ ID NO: 3469 - protein, 11 aa, Homo sapiens
ASSGQANTEAF

SEQ ID NO: 3470 - protein, 9 aa, Homo sapiens
ASSQDTEAF

SEQ ID NO: 3471 - protein, 11 aa, Homo sapiens
ASSPGANYGYT

SEQ ID NO: 3472 - protein, 10 aa, Homo sapiens
SARDSSYEQY

SEQ ID NO: 3473 - protein, 10 aa, Homo sapiens
ASSQGSYGYT

SEQ ID NO: 3474 - protein, 10 aa, Homo sapiens
ASSLRPDTQY

SEQ ID NO: 3475 - protein, 11 aa, Homo sapiens
ASSQGTNTEAF

SEQ ID NO: 3476 - protein, 10 aa, Homo sapiens
ASSQDYNEQF

SEQ ID NO: 3477 - protein, 9 aa, Homo sapiens
ASSQRDTQY

SEQ ID NO: 3478 - protein, 11 aa, Homo sapiens
ASSQDRGDTQY

SEQ ID NO: 3479 - protein, 9 aa, Homo sapiens
ASSVGTEAF

SEQ ID NO: 3480 - protein, 10 aa, Homo sapiens
ASSLRPYEQY

SEQ ID NO: 3481 - protein, 9 aa, Homo sapiens
ASSGNYGYT

SEQ ID NO: 3482 - protein, 13 aa, Homo sapiens
ASSQGLAGYNEQF

SEQ ID NO: 3483 - protein, 11 aa, Homo sapiens
ASSETVNTEAF

SEQ ID NO: 3484 - protein, 11 aa, Homo sapiens
ASSAGGTDTQY

SEQ ID NO: 3485 - protein, 12 aa, Homo sapiens
ASSLAGLTDTQY

SEQ ID NO: 3486 - protein, 11 aa, Homo sapiens
ASSLRENQPQH

SEQ ID NO: 3487 - protein, 11 aa, Homo sapiens
ASSLGHTDTQY

SEQ ID NO: 3488 - protein, 11 aa, Homo sapiens
ASSQGLYNEQF

SEQ ID NO: 3489 - protein, 12 aa, Homo sapiens
ASSLLAGQETQY

SEQ ID NO: 3490 - protein, 10 aa, Homo sapiens
ASSLGFYEQY

SEQ ID NO: 3491 - protein, 11 aa, Homo sapiens
ASSLGVGQPQH

SEQ ID NO: 3492 - protein, 11 aa, Homo sapiens
ASSLAGSYGYT

SEQ ID NO: 3493 - protein, 10 aa, Homo sapiens
ASSSHTDTQY

SEQ ID NO: 3494 - protein, 11 aa, Homo sapiens
ASSLSRQETQY

SEQ ID NO: 3495 - protein, 12 aa, Homo sapiens
ASSRQGSSYEQY

SEQ ID NO: 3496 - protein, 13 aa, Homo sapiens
ASSLGTGGYNEQF

SEQ ID NO: 3497 - protein, 12 aa, Homo sapiens
ASSSGQGADTQY

SEQ ID NO: 3498 - protein, 11 aa, Homo sapiens
ASSYGENTEAF

SEQ ID NO: 3499 - protein, 12 aa, Homo sapiens
ASSLGGTTDTQY

SEQ ID NO: 3500 - protein, 11 aa, Homo sapiens
ASSSDRNYGYT

SEQ ID NO: 3501 - protein, 12 aa, Homo sapiens
ASSSGQGQETQY

SEQ ID NO: 3502 - protein, 12 aa, Homo sapiens
ASSPGASTDTQY

SEQ ID NO: 3503 - protein, 9 aa, Homo sapiens
ASSEGDTQY

SEQ ID NO: 3504 - protein, 12 aa, Homo sapiens
ASSPDRSSYEQY

SEQ ID NO: 3505 - protein, 12 aa, Homo sapiens
ASSPTGGQETQY

SEQ ID NO: 3506 - protein, 9 aa, Homo sapiens
ASSYPDTQY

SEQ ID NO: 3507 - protein, 14 aa, Homo sapiens
ASSPRLAGGTDTQY

SEQ ID NO: 3508 - protein, 11 aa, Homo sapiens
ASSLPSSYEQY

SEQ ID NO: 3509 - protein, 10 aa, Homo sapiens
ASSRTSYEQY

SEQ ID NO: 3510 - protein, 12 aa, Homo sapiens
ASSLLAGGNEQF

SEQ ID NO: 3511 - protein, 12 aa, Homo sapiens
ASSRDRNTGELF

SEQ ID NO: 3512 - protein, 11 aa, Homo sapiens
ASSLHSNQPQH

SEQ ID NO: 3513 - protein, 12 aa, Homo sapiens
ASSSGQGNSPLH

SEQ ID NO: 3514 - protein, 9 aa, Homo sapiens
ASSVGNEQF

SEQ ID NO: 3515 - protein, 9 aa, Homo sapiens
ASSGGDTQY

SEQ ID NO: 3516 - protein, 11 aa, Homo sapiens
ASSFDGNTEAF

SEQ ID NO: 3517 - protein, 9 aa, Homo sapiens
ASSLGLEQY

SEQ ID NO: 3518 - protein, 11 aa, Homo sapiens
ASSVGRNTEAF

SEQ ID NO: 3519 - protein, 11 aa, Homo sapiens
ASSPGRNYGYT

SEQ ID NO: 3520 - protein, 10 aa, Homo sapiens
ASSRGPYEQY

SEQ ID NO: 3521 - protein, 12 aa, Homo sapiens
ASSWTGGNQPQH

SEQ ID NO: 3522 - protein, 11 aa, Homo sapiens
ASSLGRDNEQF

SEQ ID NO: 3523 - protein, 9 aa, Homo sapiens
ASSLLGEQF

SEQ ID NO: 3524 - protein, 12 aa, Homo sapiens
ASSPGQPNTEAF

SEQ ID NO: 3525 - protein, 11 aa, Homo sapiens
ASSPTGYTEAF

SEQ ID NO: 3526 - protein, 10 aa, Homo sapiens
ASSPAGYEQY

SEQ ID NO: 3527 - protein, 10 aa, Homo sapiens
ASSLIGNEQF

SEQ ID NO: 3528 - protein, 13 aa, Homo sapiens
ASSQDRGSYNEQF

SEQ ID NO: 3529 - protein, 11 aa, Homo sapiens
ASSLAANYGYT

SEQ ID NO: 3530 - protein, 10 aa, Homo sapiens
ASSLVLETQY

SEQ ID NO: 3531 - protein, 11 aa, Homo sapiens
ASSIGLNTEAF

SEQ ID NO: 3532 - protein, 11 aa, Homo sapiens
ASSLGEGTEAF

SEQ ID NO: 3533 - protein, 12 aa, Homo sapiens
ASSFGDSNQPQH

SEQ ID NO: 3534 - protein, 11 aa, Homo sapiens
ASSPDRVYGYT

SEQ ID NO: 3535 - protein, 10 aa, Homo sapiens
SARDGNQPQH

SEQ ID NO: 3536 - protein, 11 aa, Homo sapiens
ASSLRSYNEQF

SEQ ID NO: 3537 - protein, 11 aa, Homo sapiens
ASSFGGTYEQY

SEQ ID NO: 3538 - protein, 12 aa, Homo sapiens
ASSQTGGNQPQH

SEQ ID NO: 3539 - protein, 11 aa, Homo sapiens
ASSLRGAYEQY

SEQ ID NO: 3540 - protein, 12 aa, Homo sapiens
ASSQVGGNTEAF

SEQ ID NO: 3541 - protein, 12 aa, Homo sapiens
ASSLDRGNYGYT

SEQ ID NO: 3542 - protein, 10 aa, Homo sapiens
ASSAQGYEQY

SEQ ID NO: 3543 - protein, 12 aa, Homo sapiens
ASSSSSGANVLT

SEQ ID NO: 3544 - protein, 11 aa, Homo sapiens
ASSFGGADTQY

SEQ ID NO: 3545 - protein, 10 aa, Homo sapiens
ASSLLDQPQH

SEQ ID NO: 3546 - protein, 9 aa, Homo sapiens
ASSSSYGYT

SEQ ID NO: 3547 - protein, 10 aa, Homo sapiens
ASSRGTYEQY

SEQ ID NO: 3548 - protein, 11 aa, Homo sapiens
ASSTGQNTEAF

SEQ ID NO: 3549 - protein, 10 aa, Homo sapiens
ASSIGNTEAF

SEQ ID NO: 3550 - protein, 12 aa, Homo sapiens
ASSLVGVNTEAF

SEQ ID NO: 3551 - protein, 12 aa, Homo sapiens
ASSPAGGTDTQY

SEQ ID NO: 3552 - protein, 10 aa, Homo sapiens
ASSQRTDTQY

SEQ ID NO: 3553 - protein, 10 aa, Homo sapiens
ASSLVRNEQF

SEQ ID NO: 3554 - protein, 9 aa, Homo sapiens
ASSFGGEQF

SEQ ID NO: 3555 - protein, 12 aa, Homo sapiens
ASSFQGSNQPQH

SEQ ID NO: 3556 - protein, 12 aa, Homo sapiens
ASSLGTGGNEQF

SEQ ID NO: 3557 - protein, 9 aa, Homo sapiens
ASSYEETQY

SEQ ID NO: 3558 - protein, 9 aa, Homo sapiens
ASSAEETQY

SEQ ID NO: 3559 - protein, 10 aa, Homo sapiens
SARQGGTEAF

SEQ ID NO: 3560 - protein, 10 aa, Homo sapiens
ASSQVGTEAF

SEQ ID NO: 3561 - protein, 10 aa, Homo sapiens
SAREGNQPQH

SEQ ID NO: 3562 - protein, 12 aa, Homo sapiens
ASSLDGGNQPQH

SEQ ID NO: 3563 - protein, 12 aa, Homo sapiens
ASSPSGGNQPQH

SEQ ID NO: 3564 - protein, 13 aa, Homo sapiens
ASSFLAGGTDTQY

SEQ ID NO: 3565 - protein, 10 aa, Homo sapiens
ASSGQNTEAF

SEQ ID NO: 3566 - protein, 11 aa, Homo sapiens
ASSLNRGYEQY

SEQ ID NO: 3567 - protein, 11 aa, Homo sapiens
ASSSRLNTEAF

SEQ ID NO: 3568 - protein, 12 aa, Homo sapiens
ASSSGYSNQPQH

SEQ ID NO: 3569 - protein, 10 aa, Homo sapiens
ASSLGSETQY

SEQ ID NO: 3570 - protein, 12 aa, Homo sapiens
ASSLRQLNTEAF

SEQ ID NO: 3571 - protein, 10 aa, Homo sapiens
ASSYSADTQY

SEQ ID NO: 3572 - protein, 11 aa, Homo sapiens
ASSLRRTDTQY

SEQ ID NO: 3573 - protein, 11 aa, Homo sapiens
ASSLGQGNEQY

SEQ ID NO: 3574 - protein, 9 aa, Homo sapiens
ASSWNTEAF

SEQ ID NO: 3575 - protein, 12 aa, Homo sapiens
ASSQGGSGNTIY

SEQ ID NO: 3576 - protein, 12 aa, Homo sapiens
ASSPRTENTEAF

SEQ ID NO: 3577 - protein, 11 aa, Homo sapiens
ASSQGRDQPQH

SEQ ID NO: 3578 - protein, 12 aa, Homo sapiens
ASSLAGGNNEQF

SEQ ID NO: 3579 - protein, 11 aa, Homo sapiens
ASSYRDTGELF

SEQ ID NO: 3580 - protein, 10 aa, Homo sapiens
ASSFTGYEQY

SEQ ID NO: 3581 - protein, 13 aa, Homo sapiens
ASSLGQGPYNEQF

SEQ ID NO: 3582 - protein, 11 aa, Homo sapiens
ASSLARSYEQY

SEQ ID NO: 3583 - protein, 11 aa, Homo sapiens
ASSLGQIYEQY

SEQ ID NO: 3584 - protein, 13 aa, Homo sapiens
ASSLGLAVYNEQF

SEQ ID NO: 3585 - protein, 10 aa, Homo sapiens
ASSFRDTEAF

SEQ ID NO: 3586 - protein, 11 aa, Homo sapiens
ASSLARGYEQY

SEQ ID NO: 3587 - protein, 10 aa, Homo sapiens
ASSSSGETQY

SEQ ID NO: 3588 - protein, 12 aa, Homo sapiens
ASSLGSLNTEAF

SEQ ID NO: 3589 - protein, 10 aa, Homo sapiens
ASSLTPYEQY

SEQ ID NO: 3590 - protein, 11 aa, Homo sapiens
ASSPRSYNEQF

SEQ ID NO: 3591 - protein, 10 aa, Homo sapiens
ASSLGGYEQF

SEQ ID NO: 3592 - protein, 10 aa, Homo sapiens
ASSPGRTEAF

SEQ ID NO: 3593 - protein, 12 aa, Homo sapiens
ASSLGTSSYEQY

SEQ ID NO: 3594 - protein, 11 aa, Homo sapiens
ASSLAGGNTIY

SEQ ID NO: 3595 - protein, 10 aa, Homo sapiens
ASSLASETQY

SEQ ID NO: 3596 - protein, 11 aa, Homo sapiens
ASSLRVTDTQY

SEQ ID NO: 3597 - protein, 10 aa, Homo sapiens
ASSLDPDTQY

SEQ ID NO: 3598 - protein, 12 aa, Homo sapiens
ASSLGQSYNEQF

SEQ ID NO: 3599 - protein, 10 aa, Homo sapiens
ASSLQNQPQH

SEQ ID NO: 3600 - protein, 11 aa, Homo sapiens
ASSSRSSYEQY

SEQ ID NO: 3601 - protein, 10 aa, Homo sapiens
ASSLISYEQY

SEQ ID NO: 3602 - protein, 11 aa, Homo sapiens
ASSLQGRETQY

SEQ ID NO: 3603 - protein, 11 aa, Homo sapiens
ASSLAPSYEQY

SEQ ID NO: 3604 - protein, 10 aa, Homo sapiens
ASSYGGETQY

SEQ ID NO: 3605 - protein, 10 aa, Homo sapiens
ASSSLGETQY

SEQ ID NO: 3606 - protein, 11 aa, Homo sapiens
ASSQDLGYEQY

SEQ ID NO: 3607 - protein, 11 aa, Homo sapiens
ASSPDRGQPQH

SEQ ID NO: 3608 - protein, 10 aa, Homo sapiens
ASSLNGYEQY

SEQ ID NO: 3609 - protein, 11 aa, Homo sapiens
ASSLGQGGEQY

SEQ ID NO: 3610 - protein, 11 aa, Homo sapiens
ASSLRGGYGYT

SEQ ID NO: 3611 - protein, 11 aa, Homo sapiens
ASSLGLDNEQF

SEQ ID NO: 3612 - protein, 11 aa, Homo sapiens
ASSPQGDYGYT

SEQ ID NO: 3613 - protein, 11 aa, Homo sapiens
ASSYRGDTEAF

SEQ ID NO: 3614 - protein, 10 aa, Homo sapiens
ASSSYNSPLH

SEQ ID NO: 3615 - protein, 8 aa, Homo sapiens
ASGNTEAF

SEQ ID NO: 3616 - protein, 13 aa, Homo sapiens
ASSLSGGSTDTQY

SEQ ID NO: 3617 - protein, 11 aa, Homo sapiens
ASSFSSSYEQY

SEQ ID NO: 3618 - protein, 12 aa, Homo sapiens
ASSLGGLQETQY

SEQ ID NO: 3619 - protein, 11 aa, Homo sapiens
ASSLESSYEQY

SEQ ID NO: 3620 - protein, 11 aa, Homo sapiens
ASSLENTGELF

SEQ ID NO: 3621 - protein, 10 aa, Homo sapiens
ASSTSSYEQY

SEQ ID NO: 3622 - protein, 10 aa, Homo sapiens
ASSSTGDTQY

SEQ ID NO: 3623 - protein, 12 aa, Homo sapiens
ASSLGGTSYEQY

SEQ ID NO: 3624 - protein, 12 aa, Homo sapiens
ASSLSRSTDTQY

SEQ ID NO: 3625 - protein, 11 aa, Homo sapiens
ASSPGGAYEQY

SEQ ID NO: 3626 - protein, 11 aa, Homo sapiens
ASSVGGNQPQH

SEQ ID NO: 3627 - protein, 11 aa, Homo sapiens
ASSLQQNTEAF

SEQ ID NO: 3628 - protein, 9 aa, Homo sapiens
ASSTRETQY

SEQ ID NO: 3629 - protein, 11 aa, Homo sapiens
ASSSRENTEAF

SEQ ID NO: 3630 - protein, 11 aa, Homo sapiens
ASSPQGYTEAF

SEQ ID NO: 3631 - protein, 9 aa, Homo sapiens
ASSLSHEQY

SEQ ID NO: 3632 - protein, 10 aa, Homo sapiens
ASSPAGDTQY

SEQ ID NO: 3633 - protein, 11 aa, Homo sapiens
ASSSGPQETQY

SEQ ID NO: 3634 - protein, 10 aa, Homo sapiens
ASSYPNQPQH

SEQ ID NO: 3635 - protein, 11 aa, Homo sapiens
ASSEGVNTEAF

SEQ ID NO: 3636 - protein, 12 aa, Homo sapiens
ASSQDRGSYEQY

SEQ ID NO: 3637 - protein, 11 aa, Homo sapiens
ASSQDPNQPQH

SEQ ID NO: 3638 - protein, 12 aa, Homo sapiens
ASSPRTGAYEQY

SEQ ID NO: 3639 - protein, 11 aa, Homo sapiens
ASSLARDQPQH

SEQ ID NO: 3640 - protein, 11 aa, Homo sapiens
ASSSGLAYEQY

SEQ ID NO: 3641 - protein, 11 aa, Homo sapiens
ASSSGAYNEQF

SEQ ID NO: 3642 - protein, 9 aa, Homo sapiens
ASSKQETQY

SEQ ID NO: 3643 - protein, 10 aa, Homo sapiens
ASSPPGNTIY

SEQ ID NO: 3644 - protein, 11 aa, Homo sapiens
ASSQTGNQPQH

SEQ ID NO: 3645 - protein, 13 aa, Homo sapiens
ASSSTSGSYNEQF

SEQ ID NO: 3646 - protein, 12 aa, Homo sapiens
ASSLTSGTYEQY

SEQ ID NO: 3647 - protein, 10 aa, Homo sapiens
ASSTYTDTQY

SEQ ID NO: 3648 - protein, 13 aa, Homo sapiens
ASSLTGGSNQPQH

SEQ ID NO: 3649 - protein, 11 aa, Homo sapiens
ASSTDSNQPQH

SEQ ID NO: 3650 - protein, 12 aa, Homo sapiens
ASSLGGFTDTQY

SEQ ID NO: 3651 - protein, 11 aa, Homo sapiens
ASSPGQPYEQY

SEQ ID NO: 3652 - protein, 10 aa, Homo sapiens
ASSLGGEKLF

SEQ ID NO: 3653 - protein, 12 aa, Homo sapiens
ASSPRSSYNEQF

SEQ ID NO: 3654 - protein, 9 aa, Homo sapiens
ASSEGTEAF

SEQ ID NO: 3655 - protein, 12 aa, Homo sapiens
ASSSDRGNQPQH

SEQ ID NO: 3656 - protein, 10 aa, Homo sapiens
ASSVSNQPQH

SEQ ID NO: 3657 - protein, 11 aa, Homo sapiens
ASSLRQQETQY

SEQ ID NO: 3658 - protein, 12 aa, Homo sapiens
ASSLVGMNTEAF

SEQ ID NO: 3659 - protein, 9 aa, Homo sapiens
ASSFTETQY

SEQ ID NO: 3660 - protein, 9 aa, Homo sapiens
ASSENYEQY

SEQ ID NO: 3661 - protein, 9 aa, Homo sapiens
ASSRKETQY

SEQ ID NO: 3662 - protein, 10 aa, Homo sapiens
ASRTVNTEAF

SEQ ID NO: 3663 - protein, 12 aa, Homo sapiens
ASSLGSGNQPQH

SEQ ID NO: 3664 - protein, 9 aa, Homo sapiens
ASSQGGGYT

SEQ ID NO: 3665 - protein, 10 aa, Homo sapiens
ASSLGLTEAF

SEQ ID NO: 3666 - protein, 10 aa, Homo sapiens
ASSLPGNEQF

SEQ ID NO: 3667 - protein, 11 aa, Homo sapiens
ASSSRMNTEAF

SEQ ID NO: 3668 - protein, 12 aa, Homo sapiens
ASSYGQGAYEQY

SEQ ID NO: 3669 - protein, 11 aa, Homo sapiens
ASSPTANYGYT

SEQ ID NO: 3670 - protein, 12 aa, Homo sapiens
ASSSRDRGYEQY

SEQ ID NO: 3671 - protein, 13 aa, Homo sapiens
ASSSPGQGTDTQY

SEQ ID NO: 3672 - protein, 13 aa, Homo sapiens
ASSETSGSTDTQY

SEQ ID NO: 3673 - protein, 11 aa, Homo sapiens
ASSSQLNTEAF

SEQ ID NO: 3674 - protein, 10 aa, Homo sapiens
ASSPSPYEQY

SEQ ID NO: 3675 - protein, 9 aa, Homo sapiens
ASSLGHEQF

SEQ ID NO: 3676 - protein, 11 aa, Homo sapiens
ASSPPSQETQY

SEQ ID NO: 3677 - protein, 12 aa, Homo sapiens
ASSSGGGNQPQH

SEQ ID NO: 3678 - protein, 11 aa, Homo sapiens
ASSSTGGYEQY

SEQ ID NO: 3679 - protein, 12 aa, Homo sapiens
ASSFGQLNTEAF

SEQ ID NO: 3680 - protein, 11 aa, Homo sapiens
ASSLTSNTEAF

SEQ ID NO: 3681 - protein, 11 aa, Homo sapiens
ASSFQGDTEAF

SEQ ID NO: 3682 - protein, 9 aa, Homo sapiens
ASSLVDEQY

SEQ ID NO: 3683 - protein, 12 aa, Homo sapiens
ASSLGVMNTEAF

SEQ ID NO: 3684 - protein, 11 aa, Homo sapiens
ASSFRLNTEAF

SEQ ID NO: 3685 - protein, 12 aa, Homo sapiens
ASSYGTGSYEQY

SEQ ID NO: 3686 - protein, 13 aa, Homo sapiens
ASSPGTSGTYEQY

SEQ ID NO: 3687 - protein, 12 aa, Homo sapiens
ASSLRTANTEAF

SEQ ID NO: 3688 - protein, 10 aa, Homo sapiens
ASSLGTTEAF

SEQ ID NO: 3689 - protein, 12 aa, Homo sapiens
ASSLGGTQETQY

SEQ ID NO: 3690 - protein, 11 aa, Homo sapiens
ASSQGPYNEQF

SEQ ID NO: 3691 - protein, 10 aa, Homo sapiens
ASSSLGYEQY

SEQ ID NO: 3692 - protein, 10 aa, Homo sapiens
ASRDSYNEQF

SEQ ID NO: 3693 - protein, 10 aa, Homo sapiens
ASSLESDTQY

SEQ ID NO: 3694 - protein, 10 aa, Homo sapiens
ASSQGSTEAF

SEQ ID NO: 3695 - protein, 11 aa, Homo sapiens
ASSPDRGETQY

SEQ ID NO: 3696 - protein, 12 aa, Homo sapiens
ASSLAGQGYEQY

SEQ ID NO: 3697 - protein, 11 aa, Homo sapiens
ASRGTANTEAF

SEQ ID NO: 3698 - protein, 12 aa, Homo sapiens
ASSSGGSSYEQY

SEQ ID NO: 3699 - protein, 13 aa, Homo sapiens
ASSGLAGGTDTQY

SEQ ID NO: 3700 - protein, 11 aa, Homo sapiens
ASSLVGEETQY

SEQ ID NO: 3701 - protein, 10 aa, Homo sapiens
ASSEGSYEQY

SEQ ID NO: 3702 - protein, 11 aa, Homo sapiens
ASSPGGDTEAF

SEQ ID NO: 3703 - protein, 9 aa, Homo sapiens
ASSQDNEQF

SEQ ID NO: 3704 - protein, 13 aa, Homo sapiens
ASSLAGGAYNEQF

SEQ ID NO: 3705 - protein, 12 aa, Homo sapiens
ASSFTGGNQPQH

SEQ ID NO: 3706 - protein, 11 aa, Homo sapiens
ASSSRGGTEAF

SEQ ID NO: 3707 - protein, 13 aa, Homo sapiens
ASSLAGYSNQPQH

SEQ ID NO: 3708 - protein, 13 aa, Homo sapiens
ASSSTGSSYNEQF

SEQ ID NO: 3709 - protein, 13 aa, Homo sapiens
ASSLGSSYNSPLH

SEQ ID NO: 3710 - protein, 12 aa, Homo sapiens
ASSLDGGTDTQY

SEQ ID NO: 3711 - protein, 12 aa, Homo sapiens
ASSLTGSNTEAF

SEQ ID NO: 3712 - protein, 10 aa, Homo sapiens
ASSRPNTEAF

SEQ ID NO: 3713 - protein, 9 aa, Homo sapiens
ASSLETEAF

SEQ ID NO: 3714 - protein, 11 aa, Homo sapiens
ASSYPGTDTQY

SEQ ID NO: 3715 - protein, 13 aa, Homo sapiens
ASSPGTGGYNEQF

SEQ ID NO: 3716 - protein, 10 aa, Homo sapiens
ASSPTGDEQY

SEQ ID NO: 3717 - protein, 12 aa, Homo sapiens
ASSQGQGTDTQY

SEQ ID NO: 3718 - protein, 11 aa, Homo sapiens
ASSQGRTDTQY

SEQ ID NO: 3719 - protein, 12 aa, Homo sapiens
ASSPGQGRETQY

SEQ ID NO: 3720 - protein, 11 aa, Homo sapiens
ASSGTGQETQY

SEQ ID NO: 3721 - protein, 11 aa, Homo sapiens
ASSQDSGNTIY

SEQ ID NO: 3722 - protein, 10 aa, Homo sapiens
ASSLRAYEQY

SEQ ID NO: 3723 - protein, 11 aa, Homo sapiens
ASSLGTSNEQF

SEQ ID NO: 3724 - protein, 11 aa, Homo sapiens
ASSLSRDQPQH

SEQ ID NO: 3725 - protein, 11 aa, Homo sapiens
ASSLKVNTEAF

SEQ ID NO: 3726 - protein, 10 aa, Homo sapiens
ASSPGANVLT

SEQ ID NO: 3727 - protein, 10 aa, Homo sapiens
ASSLIGDTQY

SEQ ID NO: 3728 - protein, 10 aa, Homo sapiens
ASSESGYEQY

SEQ ID NO: 3729 - protein, 10 aa, Homo sapiens
ASSPSGTEAF

SEQ ID NO: 3730 - protein, 13 aa, Homo sapiens
ASSRTSGGYNEQF

SEQ ID NO: 3731 - protein, 10 aa, Homo sapiens
ASSSDYNEQF

SEQ ID NO: 3732 - protein, 11 aa, Homo sapiens
ASSLRRDTEAF

SEQ ID NO: 3733 - protein, 10 aa, Homo sapiens
ASSRNQETQY

SEQ ID NO: 3734 - protein, 14 aa, Homo sapiens
ASSSGLAGSTDTQY

SEQ ID NO: 3735 - protein, 10 aa, Homo sapiens
ASSLAGNEQY

SEQ ID NO: 3736 - protein, 11 aa, Homo sapiens
ASSSDRDQPQH

SEQ ID NO: 3737 - protein, 10 aa, Homo sapiens
ASSFTNTEAF

SEQ ID NO: 3738 - protein, 11 aa, Homo sapiens
ASSLGGDYEQY

SEQ ID NO: 3739 - protein, 10 aa, Homo sapiens
ASSPSRETQY

SEQ ID NO: 3740 - protein, 12 aa, Homo sapiens
ASSLSSGSYEQY

SEQ ID NO: 3741 - protein, 10 aa, Homo sapiens
ASSLVGGEQY

SEQ ID NO: 3742 - protein, 11 aa, Homo sapiens
ASSFTGDTEAF

SEQ ID NO: 3743 - protein, 9 aa, Homo sapiens
ASSLSDEQF

SEQ ID NO: 3744 - protein, 11 aa, Homo sapiens
ASSPGGGETQY

SEQ ID NO: 3745 - protein, 11 aa, Homo sapiens
ASSQGGYNEQF

SEQ ID NO: 3746 - protein, 14 aa, Homo sapiens
ASSPGTSGSTDTQY

SEQ ID NO: 3747 - protein, 11 aa, Homo sapiens
ASSQTENTEAF

SEQ ID NO: 3748 - protein, 11 aa, Homo sapiens
ASSFGRNQPQH

SEQ ID NO: 3749 - protein, 11 aa, Homo sapiens
ASSWGRNTEAF

SEQ ID NO: 3750 - protein, 10 aa, Homo sapiens
ASSPRNQPQH

SEQ ID NO: 3751 - protein, 9 aa, Homo sapiens
ASRGGYEQY

SEQ ID NO: 3752 - protein, 9 aa, Homo sapiens
ASSQGNTIY

SEQ ID NO: 3753 - protein, 11 aa, Homo sapiens
ASSQGSNTEAF

SEQ ID NO: 3754 - protein, 9 aa, Homo sapiens
ASSRGDEQF

SEQ ID NO: 3755 - protein, 11 aa, Homo sapiens
ASSPDRSYGYT

SEQ ID NO: 3756 - protein, 10 aa, Homo sapiens
ASSLDSNEQF

SEQ ID NO: 3757 - protein, 10 aa, Homo sapiens
ASSFSADTQY

SEQ ID NO: 3758 - protein, 11 aa, Homo sapiens
ASSLVTNTEAF

SEQ ID NO: 3759 - protein, 9 aa, Homo sapiens
ASSFAGELF

SEQ ID NO: 3760 - protein, 13 aa, Homo sapiens
ASSLDSSSYNEQF

SEQ ID NO: 3761 - protein, 11 aa, Homo sapiens
ASSRDGNYGYT

SEQ ID NO: 3762 - protein, 11 aa, Homo sapiens
ASSLSLNQPQH

SEQ ID NO: 3763 - protein, 12 aa, Homo sapiens
ASSVAGGTDTQY

SEQ ID NO: 3764 - protein, 12 aa, Homo sapiens
ASSLGQGDYGYT

SEQ ID NO: 3765 - protein, 11 aa, Homo sapiens
ASSRDRVYEQY

SEQ ID NO: 3766 - protein, 12 aa, Homo sapiens
ASSTGTGSYEQY

SEQ ID NO: 3767 - protein, 11 aa, Homo sapiens
ASSLQSSYEQY

SEQ ID NO: 3768 - protein, 11 aa, Homo sapiens
ASSLGTGNTIY

SEQ ID NO: 3769 - protein, 11 aa, Homo sapiens
ASSLLGADTQY

SEQ ID NO: 3770 - protein, 10 aa, Homo sapiens
ASSFRGQPQH

SEQ ID NO: 3771 - protein, 10 aa, Homo sapiens
ASSRTEETQY

SEQ ID NO: 3772 - protein, 12 aa, Homo sapiens
ASSPRQGQETQY

SEQ ID NO: 3773 - protein, 10 aa, Homo sapiens
ASSLTDYGYT

SEQ ID NO: 3774 - protein, 12 aa, Homo sapiens
ASSPDRMNTEAF

SEQ ID NO: 3775 - protein, 12 aa, Homo sapiens
ASSLGTSGNTIY

SEQ ID NO: 3776 - protein, 12 aa, Homo sapiens
ASSRQGANTEAF

SEQ ID NO: 3777 - protein, 10 aa, Homo sapiens
ASSFFTDTQY

SEQ ID NO: 3778 - protein, 11 aa, Homo sapiens
ASSLDKNTEAF

SEQ ID NO: 3779 - protein, 8 aa, Homo sapiens
ASSRYEQY

SEQ ID NO: 3780 - protein, 10 aa, Homo sapiens
ASSRTGYGYT

SEQ ID NO: 3781 - protein, 13 aa, Homo sapiens
ASSLGLAGGYEQY

SEQ ID NO: 3782 - protein, 11 aa, Homo sapiens
ASRQGSNQPQH

SEQ ID NO: 3783 - protein, 12 aa, Homo sapiens
ASSFGQSTDTQY

SEQ ID NO: 3784 - protein, 11 aa, Homo sapiens
ASSFGGGETQY

SEQ ID NO: 3785 - protein, 11 aa, Homo sapiens
ASSPTGGETQY

SEQ ID NO: 3786 - protein, 12 aa, Homo sapiens
ASSLAGGSDTQY

SEQ ID NO: 3787 - protein, 12 aa, Homo sapiens
ASSFGQMNTEAF

SEQ ID NO: 3788 - protein, 11 aa, Homo sapiens
ASSTSSYNEQF

SEQ ID NO: 3789 - protein, 11 aa, Homo sapiens
ASSPGLANEQF

SEQ ID NO: 3790 - protein, 11 aa, Homo sapiens
ASSLAPQETQY

SEQ ID NO: 3791 - protein, 8 aa, Homo sapiens
ASGDYEQY

SEQ ID NO: 3792 - protein, 12 aa, Homo sapiens
ASSSGQGTYEQY

SEQ ID NO: 3793 - protein, 10 aa, Homo sapiens
ASSSQGDTQY

SEQ ID NO: 3794 - protein, 11 aa, Homo sapiens
ASSLLRTDTQY

SEQ ID NO: 3795 - protein, 10 aa, Homo sapiens
ASRRGTDTQY

SEQ ID NO: 3796 - protein, 11 aa, Homo sapiens
ASSLVRGTEAF

SEQ ID NO: 3797 - protein, 11 aa, Homo sapiens
ASSLASGYEQY

SEQ ID NO: 3798 - protein, 11 aa, Homo sapiens
ASSIGRNTEAF

SEQ ID NO: 3799 - protein, 11 aa, Homo sapiens
ASSGQGAYEQY

SEQ ID NO: 3800 - protein, 11 aa, Homo sapiens
ASSSASTDTQY

SEQ ID NO: 3801 - protein, 10 aa, Homo sapiens
ASSFGPYEQY

SEQ ID NO: 3802 - protein, 13 aa, Homo sapiens
ASSLGSSSYNEQF

SEQ ID NO: 3803 - protein, 12 aa, Homo sapiens
ASSRGQGAYEQY

SEQ ID NO: 3804 - protein, 11 aa, Homo sapiens
ASSFGSNTEAF

SEQ ID NO: 3805 - protein, 11 aa, Homo sapiens
ASSEQGGTEAF

SEQ ID NO: 3806 - protein, 12 aa, Homo sapiens
ASSQGTGSYEQY

SEQ ID NO: 3807 - protein, 11 aa, Homo sapiens
ASSLGGRDTQY

SEQ ID NO: 3808 - protein, 9 aa, Homo sapiens
ASSYKETQY

SEQ ID NO: 3809 - protein, 10 aa, Homo sapiens
ASSTGNYGYT

SEQ ID NO: 3810 - protein, 10 aa, Homo sapiens
ASSLFQETQY

SEQ ID NO: 3811 - protein, 12 aa, Homo sapiens
ASSSGQGDQPQH

SEQ ID NO: 3812 - protein, 11 aa, Homo sapiens
ASSLYGNQPQH

SEQ ID NO: 3813 - protein, 11 aa, Homo sapiens
ASSLSGGYGYT

SEQ ID NO: 3814 - protein, 11 aa, Homo sapiens
ASSIGGNQPQH

SEQ ID NO: 3815 - protein, 9 aa, Homo sapiens
ASSDPYEQY

SEQ ID NO: 3816 - protein, 8 aa, Homo sapiens
SASQETQY

SEQ ID NO: 3817 - protein, 12 aa, Homo sapiens
ASSLQGSNTEAF

SEQ ID NO: 3818 - protein, 10 aa, Homo sapiens
ASSLQGNTIY

SEQ ID NO: 3819 - protein, 12 aa, Homo sapiens
ASSPGLAAYEQY

SEQ ID NO: 3820 - protein, 11 aa, Homo sapiens
ASRGTSTDTQY

SEQ ID NO: 3821 - protein, 12 aa, Homo sapiens
ASSFRDSSYEQY

SEQ ID NO: 3822 - protein, 11 aa, Homo sapiens
ASSDGSTDTQY

SEQ ID NO: 3823 - protein, 12 aa, Homo sapiens
ASSLRTVNTEAF

SEQ ID NO: 3824 - protein, 11 aa, Homo sapiens
ASSRDYTDTQY

SEQ ID NO: 3825 - protein, 11 aa, Homo sapiens
ASSRQGPYEQY

SEQ ID NO: 3826 - protein, 9 aa, Homo sapiens
ASSLSGTQY

SEQ ID NO: 3827 - protein, 12 aa, Homo sapiens
ASSPGLADNEQF

SEQ ID NO: 3828 - protein, 10 aa, Homo sapiens
ASSRDNYGYT

SEQ ID NO: 3829 - protein, 13 aa, Homo sapiens
ASSLAGGSSYEQY

SEQ ID NO: 3830 - protein, 10 aa, Homo sapiens
ASSSLQETQY

SEQ ID NO: 3831 - protein, 10 aa, Homo sapiens
ASSLPGETQY

SEQ ID NO: 3832 - protein, 11 aa, Homo sapiens
ASSVGSTDTQY

SEQ ID NO: 3833 - protein, 10 aa, Homo sapiens
ASSLVNSPLH

SEQ ID NO: 3834 - protein, 12 aa, Homo sapiens
ASSLNSGANVLT

SEQ ID NO: 3835 - protein, 9 aa, Homo sapiens
ASRSQETQY

SEQ ID NO: 3836 - protein, 10 aa, Homo sapiens
ASSLATGELF

SEQ ID NO: 3837 - protein, 10 aa, Homo sapiens
ASSPRGYGYT

SEQ ID NO: 3838 - protein, 11 aa, Homo sapiens
ASSYGPNTEAF

SEQ ID NO: 3839 - protein, 11 aa, Homo sapiens
ASSPDRSYEQY

SEQ ID NO: 3840 - protein, 12 aa, Homo sapiens
ASSRGQGTDTQY

SEQ ID NO: 3841 - protein, 10 aa, Homo sapiens
ASRYSNQPQH

SEQ ID NO: 3842 - protein, 9 aa, Homo sapiens
ASSSQYEQY

SEQ ID NO: 3843 - protein, 10 aa, Homo sapiens
ASSLRSDTQY

SEQ ID NO: 3844 - protein, 10 aa, Homo sapiens
ASRRSTDTQY

SEQ ID NO: 3845 - protein, 12 aa, Homo sapiens
ASSLGGENTEAF

SEQ ID NO: 3846 - protein, 11 aa, Homo sapiens
ASSSLGTDTQY

SEQ ID NO: 3847 - protein, 11 aa, Homo sapiens
ASSPPGNQPQH

SEQ ID NO: 3848 - protein, 12 aa, Homo sapiens
ASSLAGVQETQY

SEQ ID NO: 3849 - protein, 10 aa, Homo sapiens
ASSLNRETQY

SEQ ID NO: 3850 - protein, 11 aa, Homo sapiens
ASSPPMNTEAF

SEQ ID NO: 3851 - protein, 12 aa, Homo sapiens
ASSLGQLNQPQH

SEQ ID NO: 3852 - protein, 11 aa, Homo sapiens
ASSLRGRETQY

SEQ ID NO: 3853 - protein, 11 aa, Homo sapiens
ASSPQRNTEAF

SEQ ID NO: 3854 - protein, 10 aa, Homo sapiens
ASSLSRYEQY

SEQ ID NO: 3855 - protein, 13 aa, Homo sapiens
ASSPGLAGAYEQY

SEQ ID NO: 3856 - protein, 13 aa, Homo sapiens
ASSPGLAGVNEQF

SEQ ID NO: 3857 - protein, 11 aa, Homo sapiens
ASSRQGGETQY

SEQ ID NO: 3858 - protein, 11 aa, Homo sapiens
ASRGQGGTEAF

SEQ ID NO: 3859 - protein, 11 aa, Homo sapiens
ASSYDSYNEQF

SEQ ID NO: 3860 - protein, 11 aa, Homo sapiens
ASSRTGYNEQF

SEQ ID NO: 3861 - protein, 12 aa, Homo sapiens
ASSPDRSTDTQY

SEQ ID NO: 3862 - protein, 10 aa, Homo sapiens
ASSSLGDTQY

SEQ ID NO: 3863 - protein, 12 aa, Homo sapiens
ASSLVGRNTEAF

SEQ ID NO: 3864 - protein, 12 aa, Homo sapiens
ASSLGLSSYEQY

SEQ ID NO: 3865 - protein, 11 aa, Homo sapiens
ASSLGFNQPQH

SEQ ID NO: 3866 - protein, 11 aa, Homo sapiens
ASSPQGAYEQY

SEQ ID NO: 3867 - protein, 12 aa, Homo sapiens
ASSPDRANTEAF

SEQ ID NO: 3868 - protein, 11 aa, Homo sapiens
ASSPTPNTEAF

SEQ ID NO: 3869 - protein, 9 aa, Homo sapiens
ASSLPGELF

SEQ ID NO: 3870 - protein, 10 aa, Homo sapiens
ASSFPGNTIY

SEQ ID NO: 3871 - protein, 12 aa, Homo sapiens
ASSLRDSTDTQY

SEQ ID NO: 3872 - protein, 9 aa, Homo sapiens
ASSFYTEAF

SEQ ID NO: 3873 - protein, 10 aa, Homo sapiens
ATSDSNQPQH

SEQ ID NO: 3874 - protein, 10 aa, Homo sapiens
ASSLEQETQY

SEQ ID NO: 3875 - protein, 9 aa, Homo sapiens
ASSFPGELF

SEQ ID NO: 3876 - protein, 10 aa, Homo sapiens
ASSLVSTEAF

SEQ ID NO: 3877 - protein, 12 aa, Homo sapiens
ASSSTGMNTEAF

SEQ ID NO: 3878 - protein, 12 aa, Homo sapiens
ASSLAPSTDTQY

SEQ ID NO: 3879 - protein, 12 aa, Homo sapiens
ASSLAGLQETQY

SEQ ID NO: 3880 - protein, 12 aa, Homo sapiens
ASSLSSSGNTIY

SEQ ID NO: 3881 - protein, 11 aa, Homo sapiens
ASSQELNTEAF

SEQ ID NO: 3882 - protein, 13 aa, Homo sapiens
ASSLLAGGQETQY

SEQ ID NO: 3883 - protein, 12 aa, Homo sapiens
ASSPGLASYEQY

SEQ ID NO: 3884 - protein, 13 aa, Homo sapiens
ASSPGTGGSYEQY

SEQ ID NO: 3885 - protein, 12 aa, Homo sapiens
ASSLTGTGNTIY

SEQ ID NO: 3886 - protein, 13 aa, Homo sapiens
ASSLGTSGQETQY

SEQ ID NO: 3887 - protein, 12 aa, Homo sapiens
ASSPGTGGYGYT

SEQ ID NO: 3888 - protein, 13 aa, Homo sapiens
ASSLDRGSNQPQH

SEQ ID NO: 3889 - protein, 12 aa, Homo sapiens
ASSLTGGGQPQH

SEQ ID NO: 3890 - protein, 12 aa, Homo sapiens
ASSLGQPNQPQH

SEQ ID NO: 3891 - protein, 12 aa, Homo sapiens
ASSRGQGSYEQY

SEQ ID NO: 3892 - protein, 11 aa, Homo sapiens
ASSFEGNQPQH

SEQ ID NO: 3893 - protein, 11 aa, Homo sapiens
ASSQNSNQPQH

SEQ ID NO: 3894 - protein, 12 aa, Homo sapiens
ASSLQGGGTEAF

SEQ ID NO: 3895 - protein, 11 aa, Homo sapiens
ASSPSGGYEQY

SEQ ID NO: 3896 - protein, 11 aa, Homo sapiens
ASSLTSGNTIY

SEQ ID NO: 3897 - protein, 11 aa, Homo sapiens
ASSPRGPYEQY

SEQ ID NO: 3898 - protein, 11 aa, Homo sapiens
ASSLGDYNEQF

SEQ ID NO: 3899 - protein, 11 aa, Homo sapiens
ASSSRDSYEQY

SEQ ID NO: 3900 - protein, 11 aa, Homo sapiens
ASSGQGSYEQY

SEQ ID NO: 3901 - protein, 10 aa, Homo sapiens
ASSQATDTQY

SEQ ID NO: 3902 - protein, 11 aa, Homo sapiens
ASSLNRGETQY

SEQ ID NO: 3903 - protein, 10 aa, Homo sapiens
ASSPREETQY

SEQ ID NO: 3904 - protein, 10 aa, Homo sapiens
ASSPAGETQY

SEQ ID NO: 3905 - protein, 10 aa, Homo sapiens
ASSYSGNTIY

SEQ ID NO: 3906 - protein, 9 aa, Homo sapiens
ASGRNTEAF

SEQ ID NO: 3907 - protein, 10 aa, Homo sapiens
ASSSTGNEQF

SEQ ID NO: 3908 - protein, 11 aa, Homo sapiens
ASSLSGGQPQH

SEQ ID NO: 3909 - protein, 9 aa, Homo sapiens
ASSLWETQY

SEQ ID NO: 3910 - protein, 12 aa, Homo sapiens
ASSPGSGANVLT

SEQ ID NO: 3911 - protein, 9 aa, Homo sapiens
SARENTEAF

SEQ ID NO: 3912 - protein, 11 aa, Homo sapiens
ASSLGGAETQY

SEQ ID NO: 3913 - protein, 11 aa, Homo sapiens
ASSLKGTDTQY

SEQ ID NO: 3914 - protein, 12 aa, Homo sapiens
ASSLSGGAYEQY

SEQ ID NO: 3915 - protein, 12 aa, Homo sapiens
ASSLRGGQETQY

SEQ ID NO: 3916 - protein, 12 aa, Homo sapiens
ASSLRGVNTEAF

SEQ ID NO: 3917 - protein, 10 aa, Homo sapiens
ASSQGRTEAF

SEQ ID NO: 3918 - protein, 12 aa, Homo sapiens
ASSPTGANTEAF

SEQ ID NO: 3919 - protein, 10 aa, Homo sapiens
ASSSGDYGYT

SEQ ID NO: 3920 - protein, 11 aa, Homo sapiens
ASSPGGDYGYT

SEQ ID NO: 3921 - protein, 12 aa, Homo sapiens
ASSLGTSGNEQF

SEQ ID NO: 3922 - protein, 11 aa, Homo sapiens
ASSSQGDQPQH

SEQ ID NO: 3923 - protein, 12 aa, Homo sapiens
ASSPRTGNQPQH

SEQ ID NO: 3924 - protein, 9 aa, Homo sapiens
ASSLGVEQF

SEQ ID NO: 3925 - protein, 12 aa, Homo sapiens
ASSLGTGDQPQH

SEQ ID NO: 3926 - protein, 10 aa, Homo sapiens
ASSFQGTEAF

SEQ ID NO: 3927 - protein, 10 aa, Homo sapiens
ASSDRGTEAF

SEQ ID NO: 3928 - protein, 11 aa, Homo sapiens
ASSLRGEETQY

SEQ ID NO: 3929 - protein, 12 aa, Homo sapiens
ASSLGQKNTEAF

SEQ ID NO: 3930 - protein, 10 aa, Homo sapiens
ASSLDRDEQY

SEQ ID NO: 3931 - protein, 11 aa, Homo sapiens
ASSYSNTGELF

SEQ ID NO: 3932 - protein, 10 aa, Homo sapiens
ASSLSDTEAF

SEQ ID NO: 3933 - protein, 12 aa, Homo sapiens
ASSASGSTDTQY

SEQ ID NO: 3934 - protein, 9 aa, Homo sapiens
ASSFNYGYT

SEQ ID NO: 3935 - protein, 11 aa, Homo sapiens
ASSPTGPYEQY

SEQ ID NO: 3936 - protein, 10 aa, Homo sapiens
ASRTGTDTQY

SEQ ID NO: 3937 - protein, 10 aa, Homo sapiens
ASSGQNYGYT

SEQ ID NO: 3938 - protein, 10 aa, Homo sapiens
ASSSPGYEQY

SEQ ID NO: 3939 - protein, 9 aa, Homo sapiens
ASRTYNEQF

SEQ ID NO: 3940 - protein, 10 aa, Homo sapiens
ASSYGDTEAF

SEQ ID NO: 3941 - protein, 12 aa, Homo sapiens
ASSLQGTGNTIY

SEQ ID NO: 3942 - protein, 12 aa, Homo sapiens
ASSSQGLNTEAF

SEQ ID NO: 3943 - protein, 11 aa, Homo sapiens
ASSERGNTEAF

SEQ ID NO: 3944 - protein, 12 aa, Homo sapiens
ASSPDRSNQPQH

SEQ ID NO: 3945 - protein, 12 aa, Homo sapiens
SARLAGGTDTQY

SEQ ID NO: 3946 - protein, 11 aa, Homo sapiens
ASSLSGSTEAF

SEQ ID NO: 3947 - protein, 11 aa, Homo sapiens
ASSLGSTGELF

SEQ ID NO: 3948 - protein, 12 aa, Homo sapiens
ASSPRDSYNEQF

SEQ ID NO: 3949 - protein, 9 aa, Homo sapiens
ASSPGGGYT

SEQ ID NO: 3950 - protein, 9 aa, Homo sapiens
ASSQGNEQY

SEQ ID NO: 3951 - protein, 12 aa, Homo sapiens
ASSRTGVNTEAF

SEQ ID NO: 3952 - protein, 12 aa, Homo sapiens
ASSLTGENTEAF

SEQ ID NO: 3953 - protein, 10 aa, Homo sapiens
ASSLERETQY

SEQ ID NO: 3954 - protein, 12 aa, Homo sapiens
ASSLGGVTDTQY

SEQ ID NO: 3955 - protein, 13 aa, Homo sapiens
ASSLASGSYNEQF

SEQ ID NO: 3956 - protein, 12 aa, Homo sapiens
ASSSGTGNYGYT

SEQ ID NO: 3957 - protein, 10 aa, Homo sapiens
ASSFENTEAF

SEQ ID NO: 3958 - protein, 11 aa, Homo sapiens
ASSPRQGYEQY

SEQ ID NO: 3959 - protein, 10 aa, Homo sapiens
ASSSGLYEQY

SEQ ID NO: 3960 - protein, 12 aa, Homo sapiens
ASSLSGAYNEQF

SEQ ID NO: 3961 - protein, 11 aa, Homo sapiens
ASSPGAYNEQF

SEQ ID NO: 3962 - protein, 12 aa, Homo sapiens
ASSLGGVQETQY

SEQ ID NO: 3963 - protein, 10 aa, Homo sapiens
ASSLTDYEQY

SEQ ID NO: 3964 - protein, 10 aa, Homo sapiens
ASSLGEDTQY

SEQ ID NO: 3965 - protein, 13 aa, Homo sapiens
ASSPPGSSYNEQF

SEQ ID NO: 3966 - protein, 12 aa, Homo sapiens
ASSFRGSYNEQF

SEQ ID NO: 3967 - protein, 11 aa, Homo sapiens
ASSGTLNTEAF

SEQ ID NO: 3968 - protein, 10 aa, Homo sapiens
ASSFDTDTQY

SEQ ID NO: 3969 - protein, 9 aa, Homo sapiens
ASSIGYEQY

SEQ ID NO: 3970 - protein, 10 aa, Homo sapiens
ASSLAGDGYT

SEQ ID NO: 3971 - protein, 11 aa, Homo sapiens
ASRGQPNTEAF

SEQ ID NO: 3972 - protein, 10 aa, Homo sapiens
ASRDRAYEQY

SEQ ID NO: 3973 - protein, 11 aa, Homo sapiens
ASSLARNQPQH

SEQ ID NO: 3974 - protein, 10 aa, Homo sapiens
ASSSDGYEQY

SEQ ID NO: 3975 - protein, 12 aa, Homo sapiens
ASSTGQGNTEAF

SEQ ID NO: 3976 - protein, 9 aa, Homo sapiens
AISESYEQY

SEQ ID NO: 3977 - protein, 11 aa, Homo sapiens
ASSLAPYNEQF

SEQ ID NO: 3978 - protein, 12 aa, Homo sapiens
ASSLSGGADTQY

SEQ ID NO: 3979 - protein, 11 aa, Homo sapiens
ASSWGLNTEAF

SEQ ID NO: 3980 - protein, 11 aa, Homo sapiens
ASSRTAQETQY

SEQ ID NO: 3981 - protein, 10 aa, Homo sapiens
ASSTSNQPQH

SEQ ID NO: 3982 - protein, 11 aa, Homo sapiens
ASSPDRYNEQF

SEQ ID NO: 3983 - protein, 11 aa, Homo sapiens
ATSRDRGYEQY

SEQ ID NO: 3984 - protein, 9 aa, Homo sapiens
ASSFNQPQH

SEQ ID NO: 3985 - protein, 11 aa, Homo sapiens
ASSDSSYNEQF

SEQ ID NO: 3986 - protein, 11 aa, Homo sapiens
ASSLTENQPQH

SEQ ID NO: 3987 - protein, 11 aa, Homo sapiens
ASSLGQTDTQY

SEQ ID NO: 3988 - protein, 12 aa, Homo sapiens
ASSYSRGNTEAF

SEQ ID NO: 3989 - protein, 12 aa, Homo sapiens
ASSLGLLNTEAF

SEQ ID NO: 3990 - protein, 10 aa, Homo sapiens
ASSLGHNEQF

SEQ ID NO: 3991 - protein, 9 aa, Homo sapiens
ASSVSDTQY

SEQ ID NO: 3992 - protein, 11 aa, Homo sapiens
ASSFLSTDTQY

SEQ ID NO: 3993 - protein, 9 aa, Homo sapiens
ASRITDTQY

SEQ ID NO: 3994 - protein, 11 aa, Homo sapiens
ASSYTGGTEAF

SEQ ID NO: 3995 - protein, 12 aa, Homo sapiens
ASSLGGNTDTQY

SEQ ID NO: 3996 - protein, 13 aa, Homo sapiens
ASSPGTSGQETQY

SEQ ID NO: 3997 - protein, 11 aa, Homo sapiens
ASSLDFTDTQY

SEQ ID NO: 3998 - protein, 10 aa, Homo sapiens
ASSLDSQPQH

SEQ ID NO: 3999 - protein, 11 aa, Homo sapiens
ASSQDGNTEAF

SEQ ID NO: 4000 - protein, 12 aa, Homo sapiens
ASSYSTSTDTQY

SEQ ID NO: 4001 - protein, 10 aa, Homo sapiens
ASSLRNSPLH

SEQ ID NO: 4002 - protein, 11 aa, Homo sapiens
ASSAGGNTEAF

SEQ ID NO: 4003 - protein, 11 aa, Homo sapiens
ASSLTGRETQY

SEQ ID NO: 4004 - protein, 10 aa, Homo sapiens
ASSAYTDTQY

SEQ ID NO: 4005 - protein, 12 aa, Homo sapiens
ASSLGQNTDTQY

SEQ ID NO: 4006 - protein, 12 aa, Homo sapiens
ASSLGAGSYEQY

SEQ ID NO: 4007 - protein, 11 aa, Homo sapiens
ASSQGGGYEQY

SEQ ID NO: 4008 - protein, 11 aa, Homo sapiens
ASSLRTNTEAF

SEQ ID NO: 4009 - protein, 12 aa, Homo sapiens
ASSLARSTDTQY

SEQ ID NO: 4010 - protein, 12 aa, Homo sapiens
ASSSRDSSYEQY

SEQ ID NO: 4011 - protein, 13 aa, Homo sapiens
ASSSGTGGNQPQH

SEQ ID NO: 4012 - protein, 11 aa, Homo sapiens
ASSLWGQETQY

SEQ ID NO: 4013 - protein, 12 aa, Homo sapiens
ASSRQGSGNTIY

SEQ ID NO: 4014 - protein, 9 aa, Homo sapiens
ASSPYTEAF

Now, therefore, the following is claimed:

1. A method for determining the immunorepertoire diversity in a patient, the method comprising:

(a) amplifying polynucleotides from a population of white blood cells from a human or animal subject in a reaction mix comprising target-specific nested primers directed to variable regions of the cells, to produce a set of first amplicons, at least a portion of the target-specific nested primers comprising additional nucleotides which, during amplification, serve as a template for incorporating into the first amplicons a binding site for at least one common primer;

(b) transferring a portion of the first reaction mix containing the first amplicons to a second reaction mix comprising at least one common primer;

(c) amplifying, using the at least one common primer, the first amplicons to produce a set of second amplicons;

(d) sequencing the second amplicons to identify CDR3 sequences in the subpopulation of white blood cells;

(e) using the identified CDR3 sequences to quantify the percentage of pCDR3 represented by the sample to provide a normality index, wherein pCDR3 sequences are shared by and identified from a reference pool of individuals and wherein the pCDR3 includes 100 or more of the group consisting of SEQ ID NO:1 through SEQ ID NO: 4014; and (f) identifying whether the normality index is normal or abnormal, wherein a normal state is characterized by the normality index meeting or exceeding a minimum percentage of pCDR3 and an abnormal state is characterized by the normality index failing to meet or exceed a minimum percentage of pCDR3.

2. The method of claim 1, wherein the population of cells is selected from the group consisting of all T cells [panT], CD8+ T cells [cytotoxic T (Ta)], CD4+ T cells and their subsets [TH1, TH2, TH17, regulatory T (Treg), follicular T (TFH)], developmental subsets of T cells, such as naive T (Tn), activated T (Ta), and memory T (Tm).

3. The method of claim 1, wherein the population of white blood cells is about 100,000 randomly-selected cells.

4. The method of claim 1, wherein the method is repeated about 10 to 100 times, each time with a random selection of cells, to determine the average percentage of pCDR3 expressed by the patient.

5. The method of claim 1, wherein the minimum percentage of pCDR3 is a percentage number from about 25 to about 75.

6. The method of claim 1, wherein the minimum percentage of pCDR3 is about 25 percent.

7. The method of claim 1, wherein the pCDR3 is composed of at least the 1000 most-frequently-shared CDR3 from the reference pool of individuals.

8. The method of claim 1, wherein the pCDR3 includes SEQ ID NO:1 through SEQ ID NO: 4014.

9. The method of claim 1, wherein the pCDR3 is composed of CDR3 shared by at least 50 percent of the pool of individuals.

10. The method of claim 9, wherein the pool contains at least 100 individuals.

11. The method of claim 9, wherein the pool contains about 1000 individuals.

12. The method of claim 9, wherein the pool is composed of healthy control individuals.

13. The method of claim 9, wherein the pool is composed of individuals with one or more specific disease states.

14. The method of claim 9, wherein the pool of individuals is approximately age-matched to the patient.

15. The method of claim 9, wherein the pool of individuals is gender-matched to the patient.

* * * * *